US012807719B2

(12) United States Patent
Desjarlais et al.

(10) Patent No.: US 12,807,719 B2
(45) Date of Patent: Nov. 24, 2026

(54) HETERODIMERIC ANTIBODIES THAT BIND TGFβRII

(71) Applicant: Xencor, Inc., Monrovia, CA (US)

(72) Inventors: John R. Desjarlais, Pasadena, CA (US); Gregory Moore, Azusa, CA (US); Suzanne Schubbert, Long Beach, CA (US); Alex Nisthal, Monrovia, CA (US)

(73) Assignee: Xencor, Inc., Pasadena, CA (US)

( * ) Notice: Subject to any disclaimer, the term of this patent is extended or adjusted under 35 U.S.C. 154(b) by 486 days.

(21) Appl. No.: 17/520,590

(22) Filed: Nov. 5, 2021

(65) Prior Publication Data

US 2022/0144956 A1 May 12, 2022

Related U.S. Application Data

(60) Provisional application No. 63/110,908, filed on Nov. 6, 2020.

(51) Int. Cl.
*C07K 16/28* (2006.01)
*C12N 15/63* (2006.01)

(52) U.S. Cl.
CPC ...... *C07K 16/2863* (2013.01); *C07K 16/2896* (2013.01); *C12N 15/63* (2013.01); *C07K 2317/31* (2013.01); *C07K 2317/515* (2013.01); *C07K 2317/52* (2013.01); *C07K 2317/622* (2013.01)

(58) Field of Classification Search
CPC .............. A61K 47/68; A61K 2039/507; A61K 2039/505; C07K 2317/56; C07K 16/2863; C07K 16/2896; C07K 2317/31; C07K 2317/515; C07K 2317/52; C07K 2317/622; C07K 2317/24; C07K 2317/92; C07K 2317/64; C07K 2317/76; C07K 2317/94; C07K 16/2818; C12N 15/63; A61P 35/00
See application file for complete search history.

(56) References Cited

U.S. PATENT DOCUMENTS

| | | | |
|---|---|---|---|
| 3,773,919 | A | 11/1973 | Boswell et al. |
| 4,169,888 | A | 10/1979 | Hanka et al. |
| 4,179,337 | A | 12/1979 | Davis et al. |
| 4,256,746 | A | 3/1981 | Miyashita et al. |
| 4,294,757 | A | 10/1981 | Asai |
| 4,301,144 | A | 11/1981 | Iwashita et al. |
| 4,307,016 | A | 12/1981 | Asai et al. |
| 4,313,946 | A | 2/1982 | Powell et al. |
| 4,315,929 | A | 2/1982 | Freedman et al. |
| 4,322,348 | A | 3/1982 | Asai et al. |
| 4,331,598 | A | 5/1982 | Hasegawa et al. |
| 4,361,650 | A | 11/1982 | Asai et al. |
| 4,362,663 | A | 12/1982 | Kida et al. |
| 4,364,866 | A | 12/1982 | Asai et al. |
| 4,364,935 | A | 12/1982 | Kung et al. |
| 4,371,533 | A | 2/1983 | Akimoto et al. |
| 4,424,219 | A | 1/1984 | Hashimoto et al. |
| 4,450,254 | A | 5/1984 | Isley et al. |
| 4,496,689 | A | 1/1985 | Mitra |
| 4,640,835 | A | 2/1987 | Shimizu et al. |
| 4,670,417 | A | 6/1987 | Iwasaki et al. |
| 4,791,192 | A | 12/1988 | Nakagawa et al. |
| 4,880,935 | A | 11/1989 | Thorpe |
| 4,923,990 | A | 5/1990 | Nakano et al. |
| 4,943,533 | A | 7/1990 | Mendelsohn et al. |
| 4,970,198 | A | 11/1990 | Lee et al. |
| 5,053,394 | A | 10/1991 | Ellestad et al. |
| 5,070,092 | A | 12/1991 | Kanda et al. |
| 5,084,468 | A | 1/1992 | Saito et al. |
| 5,101,038 | A | 3/1992 | Nakano et al. |
| 5,122,368 | A | 6/1992 | Greenfield et al. |
| 5,187,186 | A | 2/1993 | Kanda et al. |
| 5,208,020 | A | 5/1993 | Chari et al. |
| 5,264,586 | A | 11/1993 | Nicolaou et al. |
| 5,384,412 | A | 1/1995 | Nicolaou et al. |
| 5,416,064 | A | 5/1995 | Chari et al. |

(Continued)

FOREIGN PATENT DOCUMENTS

| | | | |
|---|---|---|---|
| CN | 107840891 | A | 3/2018 |
| EP | 0425235 | B1 | 9/1996 |

(Continued)

OTHER PUBLICATIONS

Newsted D, et al. Blockade of TGF-β signaling with novel synthetic antibodies limits immune exclusion and improves chemotherapy response in metastatic ovarian cancer models. Oncoimmunology. Nov. 2, 20180;8(2):e1539613. doi: 10.1080/2162402X.2018.1539613. PMID: 30713798; PMCID: PMC6343786. (Year: 2018).*

Chiu ML, Goulet DR, Teplyakov A, Gilliland GL. Antibody Structure and Function: The Basis for Engineering Therapeutics. Antibodies (Basel). Dec. 3, 2019;8(4):55. doi: 10.3390/antib8040055. PMID: 31816964; PMCID: PMC6963682. (Year: 2019).*

Janeway CA Jr, Travers P, Walport M, et al. Immunobiology: The Immune System in Health and Disease. 5th edition. New York: Garland Science; 2001. The structure of a typical antibody molecule. Available from: https://www.ncbi.nlm.nih.gov/books/NBK27144/ (Year: 2001).*

(Continued)

*Primary Examiner* — Julie Wu
*Assistant Examiner* — Amy M. Chattin
(74) *Attorney, Agent, or Firm* — Louis-Vu T. Nguyen; Christopher J. Betti; Morgan, Lewis & Bockius, LLP

(57) ABSTRACT

Provided herein are novel antibodies that bind TGFßRII and methods of making and using such antibodies. The antibodies provided advantageously block TGFß activity in a broad population of cells (e.g., active and unactivated hematopoietic cells), and find use wherein such blockage of TGFß activity is desirable, for example, for the treatment of cancers. In some embodiments, the antibodies are novel αTGFßRII×αCD5 and αTGFßRII×αPD-1 bispecific antibodies.

3 Claims, 178 Drawing Sheets

Specification includes a Sequence Listing.

(56) References Cited

U.S. PATENT DOCUMENTS 5,475,092 A 12/1995 Chari et al.
5,500,362 A 3/1996 Robinson et al.
5,530,101 A 6/1996 Queen et al.
5,541,087 A 7/1996 Lo et al.
5,550,246 A 8/1996 Nicolaou et al.
5,558,864 A 9/1996 Bendig et al.
5,571,714 A 11/1996 Dasch et al.
5,585,089 A 12/1996 Queen et al.
5,585,097 A 12/1996 Bolt et al.
5,585,499 A 12/1996 Chari et al.
5,622,929 A 4/1997 Willner et al.
5,635,483 A 6/1997 Pettit et al.
5,641,780 A 6/1997 Amishiro et al.
5,663,149 A 9/1997 Pettit et al.
5,677,171 A 10/1997 Hudziak et al.
5,693,761 A 12/1997 Queen et al.
5,693,762 A 12/1997 Queen et al.
5,703,080 A 12/1997 Nakakura et al.
5,712,374 A 1/1998 Kuntsmann et al.
5,714,586 A 2/1998 Kuntsmann et al.
5,726,044 A 3/1998 Lo et al.
5,731,168 A 3/1998 Carter et al.
5,736,137 A 4/1998 Anderson et al.
5,739,116 A 4/1998 Hamann et al.
5,767,237 A 6/1998 Sakakibara et al.
5,767,285 A 6/1998 Hamann et al.
5,770,701 A 6/1998 McGahren et al.
5,770,710 A 6/1998 McGahren et al.
5,773,001 A 6/1998 Hamann et al.
5,780,588 A 7/1998 Pettit et al.
5,807,706 A 9/1998 Carter et al.
5,821,333 A 10/1998 Carter et al.
5,821,337 A 10/1998 Carter et al.
5,824,805 A 10/1998 King et al.
5,846,545 A 12/1998 Chari et al.
5,859,205 A 1/1999 Adair et al.
5,877,291 A 3/1999 Mezes et al.
5,877,296 A 3/1999 Hamann et al.
5,891,996 A 4/1999 Mateo de Acosta del Rio et al.
5,892,020 A 4/1999 Mezes et al.
5,945,311 A 8/1999 Lindhofer et al.
5,968,509 A 10/1999 Gorman et al.
6,054,297 A 4/2000 Carter et al.
6,071,515 A 6/2000 Mezes et al.
6,124,431 A 9/2000 Sakakibara et al.
6,177,078 B1 1/2001 Lopez
6,180,370 B1 1/2001 Queen et al.
6,214,345 B1 4/2001 Firestone et al.
6,235,883 B1 5/2001 Jakobovits et al.
6,329,507 B1 12/2001 Mezes et al.
6,407,213 B1 6/2002 Carter et al.
6,441,163 B1 8/2002 Chari et al.
6,455,677 B1 9/2002 Park et al.
6,506,883 B2 1/2003 Meteo de Acosta del Rio et al.
6,602,684 B1 8/2003 Umana et al.
6,632,927 B2 10/2003 Adair et al.
6,706,265 B1 3/2004 Bolt et al.
6,716,410 B1 4/2004 Witztum
6,723,538 B2 4/2004 Mack et al.
6,884,869 B2 4/2005 Senter et al.
6,989,452 B2 1/2006 Ng et al.
7,087,600 B2 8/2006 Ng et al.
7,112,324 B1 9/2006 Dorken et al.
7,129,261 B2 10/2006 Ng et al.
7,276,497 B2 10/2007 Chari et al.
7,303,749 B1 12/2007 Chari
7,368,565 B2 5/2008 Chari et al.
7,494,651 B2 2/2009 Jones et al.
7,498,302 B2 3/2009 Ng et al.
7,507,420 B2 3/2009 Ng et al.
7,517,903 B2 4/2009 Chen et al.
7,527,791 B2 5/2009 Adams et al.
7,579,186 B1 8/2009 Sakamoto et al.
7,601,354 B2 10/2009 Chari
7,642,228 B2 1/2010 Carter et al.
7,691,962 B2 4/2010 Boyd et al.
7,695,936 B2 4/2010 Carter et al.
7,696,338 B2 4/2010 Neville, Jr. et al.
7,728,114 B2 6/2010 Mach et al.
7,850,962 B2 12/2010 Teeling et al.
8,063,187 B2 11/2011 Chu et al.
8,114,967 B2 2/2012 Bhatt et al.
8,216,805 B2 7/2012 Carter et al.
8,236,308 B2 8/2012 Kischel et al.
8,309,690 B2 11/2012 Allan et al.
8,367,805 B2 2/2013 Chamberlain et al.
8,409,568 B2 4/2013 Gao et al.
8,592,562 B2 11/2013 Kannan et al.
8,637,641 B2 1/2014 Dahiyat et al.
8,679,500 B2 3/2014 Boumsell et al.
8,946,387 B2 2/2015 Koenig et al.
9,181,334 B2 11/2015 Kobayashi et al.
9,334,331 B2 * 5/2016 Igawa .................... C07K 16/36
9,822,181 B2 11/2017 Bonvini et al.
9,856,327 B2 1/2018 Bernett et al.
10,174,108 B2 1/2019 Ledbetter et al.
10,227,410 B2 3/2019 Moore et al.
10,421,807 B2 * 9/2019 Gonzales ................ A61P 17/08
10,428,155 B2 10/2019 Moore et al.
10,526,417 B2 1/2020 Bernett et al.
10,787,518 B2 * 9/2020 Bernett .............. C07K 16/2818
11,066,483 B2 7/2021 Nezu et al.
11,377,477 B2 * 7/2022 Bernett .................. A61P 35/00
2002/0076406 A1 6/2002 Leung
2002/0103345 A1 8/2002 Zhu
2002/0131968 A1 9/2002 Waldmann et al.
2003/0003097 A1 1/2003 Reff et al.
2003/0017979 A1 1/2003 Mack et al.
2003/0091561 A1 5/2003 Van de Winkel
2003/0157108 A1 8/2003 Presta
2003/0223999 A1 12/2003 Lindhofer
2004/0018191 A1 1/2004 Wang
2004/0071696 A1 4/2004 Adams et al.
2004/0162411 A1 8/2004 Lanzavecchia
2004/0170626 A1 9/2004 Schuurman
2004/0242851 A1 12/2004 Zhu
2005/0100543 A1 5/2005 Hansen et al.
2005/0114037 A1 5/2005 Desjarlais et al.
2005/0136050 A1 6/2005 Kufer et al.
2005/0142133 A1 6/2005 Lazar et al.
2005/0176028 A1 8/2005 Hofmeiser et al.
2005/0191702 A1 9/2005 Mack et al.
2005/0238648 A1 10/2005 Jacobs
2005/0238649 A1 10/2005 Doronina
2006/0008883 A1 1/2006 Lazar
2006/0018897 A1 1/2006 Lee et al.
2006/0024298 A1 2/2006 Lazar et al.
2006/0024317 A1 2/2006 Boyd
2006/0073142 A1 4/2006 Chan et al.
2006/0074008 A1 4/2006 Senter
2006/0115481 A1 6/2006 Lindhofer et al.
2006/0121032 A1 6/2006 Dahiyat et al.
2006/0134105 A1 6/2006 Lazar et al.
2006/0235208 A1 10/2006 Lazar
2007/0071675 A1 3/2007 Wu et al.
2007/0105199 A1 5/2007 Yan et al.
2007/0123479 A1 5/2007 Kufer et al.
2007/0148170 A1 6/2007 Desjarlais
2007/0287170 A1 12/2007 Davis et al.
2008/0044413 A1 2/2008 Hammond et al.
2008/0050370 A1 2/2008 Glaser et al.
2008/0138335 A1 6/2008 Takahashi et al.
2008/0213273 A1 9/2008 Burge
2008/0219974 A1 9/2008 Bernett et al.
2008/0242845 A1 10/2008 Lazar et al.
2009/0004195 A1 1/2009 Vranic et al.
2009/0082213 A1 3/2009 Horowitz et al.
2009/0163699 A1 6/2009 Desjarlais
2009/0214539 A1 8/2009 Grosmaire et al.
2009/0252683 A1 10/2009 Kischel et al.
2009/0252729 A1 10/2009 Farrington et al.
2009/0274692 A1 11/2009 Tan et al.
2009/0311253 A1 12/2009 Ghayur et al.
2009/0317869 A1 12/2009 Alley et al.

(56) References Cited

U.S. PATENT DOCUMENTS

2010/0004431 A1 1/2010 Bernett et al.
2010/0015133 A1 1/2010 Igawa et al.
2010/0080814 A1 4/2010 Desjarlais et al.
2010/0119516 A1* 5/2010 Wu ........................ A61P 43/00 424/139.1
2010/0150918 A1 6/2010 Kufer et al.
2010/0174053 A1 7/2010 Johnson et al.
2010/0178298 A1 7/2010 Lindhofer
2010/0183554 A1 7/2010 Mach et al.
2010/0226925 A1 9/2010 Dillon et al.
2010/0239567 A1 9/2010 Esue
2010/0239582 A1 9/2010 Humphreys et al.
2010/0256339 A1 10/2010 Bossenmaier et al.
2010/0256340 A1 10/2010 Brinkmann et al.
2010/0298542 A1 11/2010 Igawa et al.
2010/0322933 A1 12/2010 Lindhofer et al.
2010/0330089 A1 12/2010 Damle et al.
2010/0331527 A1 12/2010 Davis et al.
2011/0008364 A1 1/2011 Ledbetter et al.
2011/0054151 A1 3/2011 Lazar et al.
2011/0076275 A1 3/2011 Igawa et al.
2011/0177500 A1 7/2011 Winther et al.
2011/0189178 A1 8/2011 Desjarlais et al.
2011/0189209 A1 8/2011 Neville, Jr. et al.
2011/0201032 A1 8/2011 Zeng et al.
2011/0217302 A1 9/2011 Odegard et al.
2011/0250203 A1 10/2011 Klitgaard et al.
2011/0262439 A1 10/2011 Kufer et al.
2011/0275787 A1 11/2011 Kufer et al.
2011/0293619 A1 12/2011 Kufer et al.
2012/0028304 A1 2/2012 Dahiyat et al.
2012/0034228 A1 2/2012 Kufer et al.
2012/0121597 A1 5/2012 Ho et al.
2012/0149876 A1 6/2012 Von Kreudenstein et al.
2012/0156207 A1 6/2012 Chu et al.
2012/0251531 A1 10/2012 Baehner et al.
2012/0251541 A1 10/2012 Baurin et al.
2013/0089541 A1 4/2013 D'Angelo et al.
2013/0095097 A1 4/2013 Blakenship et al.
2013/0101586 A1 4/2013 Riegler et al.
2013/0115208 A1 5/2013 Ho et al.
2013/0129723 A1 5/2013 Blakenship et al.
2013/0142793 A1 6/2013 Ledbetter et al.
2013/0171095 A1 7/2013 Bernett et al.
2013/0195849 A1 8/2013 Von Kreudenstein et al.
2013/0209355 A1 8/2013 De Weers et al.
2013/0267686 A1 10/2013 Brinkmann
2013/0302335 A1* 11/2013 Beaton .................. C12N 15/09 435/254.11
2013/0336981 A1 12/2013 de Kruif et al.
2014/0024111 A1 1/2014 Kannan et al.
2014/0056879 A1 2/2014 Lazar
2014/0072581 A1 3/2014 Dixit et al.
2014/0086916 A1 3/2014 Zha
2014/0161790 A1 6/2014 Desjarlais et al.
2014/0212435 A1 7/2014 Moore et al.
2014/0212436 A1 7/2014 Moore et al.
2014/0249297 A1 9/2014 Lazar et al.
2014/0288275 A1 9/2014 Moore et al.
2014/0294759 A1 10/2014 Chu et al.
2014/0294823 A1 10/2014 Moore et al.
2014/0294833 A1 10/2014 Desjarlais et al.
2014/0294835 A1 10/2014 Moore et al.
2014/0294836 A1 10/2014 Chu et al.
2014/0302064 A1 10/2014 Moore
2014/0322217 A1 10/2014 Moore et al.
2014/0356381 A1 12/2014 Moore et al.
2014/0363426 A1 12/2014 Moore et al.
2014/0370013 A1 12/2014 Desjarlais et al.
2014/0370020 A1 12/2014 Kuramochi et al.
2014/0377269 A1 12/2014 Mabry et al.
2014/0377270 A1 12/2014 Moore et al.
2015/0071948 A1 3/2015 Lazar et al.
2015/0119555 A1 4/2015 Jung et al.
2015/0307628 A1 10/2015 Kim et al.
2015/0307629 A1 10/2015 Bernett et al.
2016/0060360 A1 3/2016 Moore et al.
2016/0068588 A1 3/2016 Bernett et al.
2016/0176969 A1 6/2016 Bernett et al.
2016/0215063 A1 7/2016 Bernett et al.
2016/0229924 A1 8/2016 Bernett et al.
2016/0355608 A1 12/2016 Bernett et al.
2016/0367663 A1* 12/2016 Doshi ................ C07K 16/2896
2016/0376373 A1* 12/2016 Ahmadi ............. C07K 16/2896 424/136.1
2017/0020963 A1 1/2017 Qu et al.
2017/0210799 A1* 7/2017 Anderson ............... A61P 35/00
2017/0320947 A1 11/2017 Moore et al.
2018/0105597 A1* 4/2018 Burtrum ............ C07K 16/2863
2018/0118828 A1 5/2018 Bernett et al.
2018/0118836 A1 5/2018 Bernett et al.
2018/0127501 A1 5/2018 Bernett et al.
2018/0207267 A1 7/2018 Schurpf et al.
2018/0244763 A1 8/2018 Shapiro et al.
2018/0305465 A1 10/2018 Stevens et al.
2019/0106504 A1 4/2019 Wu et al.
2019/0263909 A1 8/2019 Bernett et al.
2019/0270816 A1 9/2019 Bernett et al.
2019/0314411 A1 10/2019 Xiao et al.
2019/0345252 A1 11/2019 Kinsella et al.
2019/0382495 A1 12/2019 Bernett et al.
2019/0389954 A1 12/2019 Bernett et al.
2021/0102002 A1 4/2021 Bernett et al.

FOREIGN PATENT DOCUMENTS

EP 1752471 2/2007
EP 1829895 5/2007
EP 2006381 12/2008
EP 2009101 A1 12/2008
EP 2194066 6/2010
EP 2202245 A1 6/2010
EP 2522724 6/2011
EP 2155788 2/2014
EP 3199628 A1 8/2017
EP 3252078 12/2017
EP 3339326 A1 6/2018
PH 12009501037 B1 * 3/2013
RU 2014114179 A 10/2015
WO WO8705330 9/1987
WO WO9211018 7/1992
WO WO9321232 10/1993
WO WO9413804 5/1994
WO WO9520045 1/1995
WO WO9640210 6/1996
WO WO96027011 9/1996
WO WO1997024373 7/1997
WO WO1997044352 A1 11/1997
WO WO98050431 11/1998
WO WO199937791 7/1999
WO WO99054440 10/1999
WO WO99066951 12/1999
WO WO200061739 A1 10/2000
WO WO200124763 A2 4/2001
WO WO200129246 A1 4/2001
WO WO200162931 A1 8/2001
WO WO200188138 11/2001
WO WO2001083525 11/2001
WO WO2001090192 11/2001
WO WO200216368 2/2002
WO WO200230954 A1 4/2002
WO WO200231140 A1 4/2002
WO WO2002088172 A2 7/2002
WO WO2002062850 8/2002
WO WO2002083180 10/2002
WO WO2002098883 12/2002
WO WO2004010957 2/2004
WO WO2004043493 5/2004
WO WO2004103272 12/2004
WO WO2004106383 12/2004
WO WO2005063816 7/2005
WO WO2005112919 A2 12/2005
WO WO2005118635 12/2005
WO WO2006020258 2/2006

(56) References Cited

FOREIGN PATENT DOCUMENTS

| | | | | | |
|---|---|---|---|---|---|
| WO | WO2006034488 | | 3/2006 | | |
| WO | WO2006036834 | | 4/2006 | | |
| WO | WO2006072620 | | 7/2006 | | |
| WO | WO2006110476 | A2 | 10/2006 | | |
| WO | WO 2006124641 | A2 | 11/2006 | | |
| WO | WO2006106905 | | 12/2006 | | |
| WO | WO2006131013 | | 12/2006 | | |
| WO | WO2007005612 | | 1/2007 | | |
| WO | WO2007018431 | A2 | 2/2007 | | |
| WO | WO2007033230 | | 3/2007 | | |
| WO | WO2007042261 | | 4/2007 | | |
| WO | WO2007042309 | A2 | 4/2007 | | |
| WO | WO2007046006 | | 4/2007 | | |
| WO | WO2007047829 | | 4/2007 | | |
| WO | WO2007059404 | A2 | 5/2007 | | |
| WO | WO2007062037 | | 5/2007 | | |
| WO | WO2007084342 | | 7/2007 | | |
| WO | WO2007089149 | A2 | 8/2007 | | |
| WO | WO2007093630 | | 8/2007 | | |
| WO | WO2007098934 | | 9/2007 | | |
| WO | WO2007110205 | | 10/2007 | | |
| WO | WO2007113648 | | 10/2007 | | |
| WO | WO20070147901 | | 12/2007 | | |
| WO | WO2008003103 | | 1/2008 | | |
| WO | WO2008003115 | | 1/2008 | | |
| WO | WO2008003116 | | 1/2008 | | |
| WO | WO2008048942 | | 4/2008 | | |
| WO | WO2008119096 | | 10/2008 | | |
| WO | WO2008119566 | | 10/2008 | | |
| WO | WO2008124858 | | 10/2008 | | |
| WO | WO 2008143684 | A1 | 11/2008 | | |
| WO | WO2008145142 | | 12/2008 | | |
| WO | WO2008150494 | | 12/2008 | | |
| WO | WO2009000006 | | 12/2008 | | |
| WO | WO2009017394 | A1 | 2/2009 | | |
| WO | WO2009017823 | | 2/2009 | | |
| WO | WO2009030734 | | 3/2009 | | |
| WO | WO2009032782 | | 3/2009 | | |
| WO | WO2009086320 | | 7/2009 | | |
| WO | WO2009089004 | | 7/2009 | | |
| WO | WO2009106096 | | 9/2009 | | |
| WO | WO2009106321 | | 9/2009 | | |
| WO | WO2010022737 | A1 | 3/2010 | | |
| WO | WO2010028796 | | 3/2010 | | |
| WO | WO2010033736 | | 3/2010 | | |
| WO | WO2010034441 | | 4/2010 | | |
| WO | WO2010037835 | | 4/2010 | | |
| WO | WO2010042904 | | 4/2010 | | |
| WO | WO2010062171 | A2 | 6/2010 | | |
| WO | WO2010085682 | | 7/2010 | | |
| WO | WO2010106180 | | 9/2010 | | |
| WO | WO2010115551 | | 10/2010 | | |
| WO | WO2010115552 | | 10/2010 | | |
| WO | WO2010115553 | | 10/2010 | | |
| WO | WO2010115589 | | 10/2010 | | |
| WO | WO2010119119 | | 10/2010 | | |
| WO | WO20100112193 | | 10/2010 | | |
| WO | WO2010136172 | | 12/2010 | | |
| WO | WO2010151792 | | 12/2010 | | |
| WO | WO2010151808 | | 12/2010 | | |
| WO | WO2011005621 | | 1/2011 | | |
| WO | WO2011028952 | | 3/2011 | | |
| WO | WO2011036183 | | 3/2011 | | |
| WO | WO2011066342 | | 3/2011 | | |
| WO | WO2011051307 | | 5/2011 | | |
| WO | WO2011063348 | | 5/2011 | | |
| WO | WO2011066501 | | 6/2011 | | |
| WO | WO 2011097603 | A1 | 8/2011 | | |
| WO | WO2011121110 | | 10/2011 | | |
| WO | WO2011131746 | | 10/2011 | | |
| WO | WO2011133886 | | 10/2011 | | |
| WO | WO2011143545 | | 11/2011 | | |
| WO | WO2011154453 | A1 | 12/2011 | | |
| WO | WO2011159877 | | 12/2011 | | |
| WO | WO2012016227 | | 2/2012 | | |
| WO | WO2012018687 | | 2/2012 | | |
| WO | WO2012032080 | | 3/2012 | | |
| WO | WO2012058768 | | 5/2012 | | |
| WO | WO2012062596 | | 5/2012 | | |
| WO | WO-2012093125 | A1 | * | 7/2012 | ......... C07K 16/2863 |
| WO | WO2012107417 | | 8/2012 | | |
| WO | WO2012116453 | | 9/2012 | | |
| WO | WO2012125495 | | 9/2012 | | |
| WO | WO2012125850 | | 9/2012 | | |
| WO | WO2012131555 | | 10/2012 | | |
| WO | WO2012146394 | | 11/2012 | | |
| WO | WO2012146628 | | 11/2012 | | |
| WO | WO2012162067 | | 11/2012 | | |
| WO | WO2013006544 | | 1/2013 | | |
| WO | WO2013016714 | | 1/2013 | | |
| WO | WO2013018892 | | 2/2013 | | |
| WO | WO2013022855 | | 2/2013 | | |
| WO | WO2013023251 | | 2/2013 | | |
| WO | WO2013026833 | | 2/2013 | | |
| WO | WO2013033008 | | 3/2013 | | |
| WO | WO2013047748 | | 4/2013 | | |
| WO | WO2013055809 | | 4/2013 | | |
| WO | WO2013059885 | A2 | 5/2013 | | |
| WO | WO2013063702 | | 5/2013 | | |
| WO | WO2013070565 | | 5/2013 | | |
| WO | WO2013096828 | | 6/2013 | | |
| WO | WO2013125667 | | 8/2013 | | |
| WO | WO2013164694 | | 11/2013 | | |
| WO | WO2013173820 | A2 | 11/2013 | | |
| WO | WO2013180201 | | 12/2013 | | |
| WO | WO2014004586 | | 1/2014 | | |
| WO | WO2014012085 | | 1/2014 | | |
| WO | WO2014018572 | | 1/2014 | | |
| WO | WO2014047231 | | 3/2014 | | |
| WO | WO2014055897 | A2 | 4/2014 | | |
| WO | WO2014056783 | | 4/2014 | | |
| WO | WO2014079000 | | 5/2014 | | |
| WO | WO2014110601 | | 7/2014 | | |
| WO | WO2014113510 | | 7/2014 | | |
| WO | WO2014145806 | | 9/2014 | | |
| WO | WO2014145907 | | 9/2014 | | |
| WO | WO2014151910 | A1 | 9/2014 | | |
| WO | WO2014164553 | | 10/2014 | | |
| WO | WO2014207064 | | 12/2014 | | |
| WO | WO2014209804 | | 12/2014 | | |
| WO | WO2015018528 | | 2/2015 | | |
| WO | WO2015026892 | | 2/2015 | | |
| WO | WO2015063339 | | 5/2015 | | |
| WO | WO2015095392 | | 6/2015 | | |
| WO | WO2015095410 | | 6/2015 | | |
| WO | WO2015095423 | | 6/2015 | | |
| WO | WO2015103072 | | 7/2015 | | |
| WO | WO2015130728 | A1 | 9/2015 | | |
| WO | WO2015143079 | | 9/2015 | | |
| WO | WO2015149077 | | 10/2015 | | |
| WO | WO2015168379 | | 11/2015 | | |
| WO | WO2015184207 | | 12/2015 | | |
| WO | WO2016014984 | | 1/2016 | | |
| WO | WO2016028672 | | 2/2016 | | |
| WO | WO2016028896 | | 2/2016 | | |
| WO | WO2016040294 | A2 | 3/2016 | | |
| WO | WO2016071355 | A1 | 5/2016 | | |
| WO | WO2016079050 | | 5/2016 | | |
| WO | WO2016086186 | | 6/2016 | | |
| WO | WO2016086189 | | 6/2016 | | |
| WO | WO2016086196 | | 6/2016 | | |
| WO | WO2016105450 | | 6/2016 | | |
| WO | WO2016110584 | | 7/2016 | | |
| WO | WO2016115274 | | 7/2016 | | |
| WO | WO2016120789 | | 8/2016 | | |
| WO | WO2016141387 | | 9/2016 | | |
| WO | WO2017072366 | A1 | 10/2016 | | |
| WO | WO2016182751 | | 11/2016 | | |
| WO | WO2016210223 | A1 | 12/2016 | | |
| WO | WO2017019846 | | 2/2017 | | |
| WO | WO2017021356 | A1 | 2/2017 | | |
| WO | WO2017023761 | A1 | 2/2017 | | |
| WO | WO2017055391 | A1 | 4/2017 | | |
| WO | WO-2017055404 | A1 | * | 4/2017 | ....... A61K 39/39533 |

(56) References Cited

FOREIGN PATENT DOCUMENTS

| | | | | |
|---|---|---|---|---|
| WO | WO2017112775 | | 6/2017 | |
| WO | WO2017134158 A1 | | 8/2017 | |
| WO | WO2017175145 A1 | | 10/2017 | |
| WO | WO2017210443 | | 12/2017 | |
| WO | WO2017210485 | | 12/2017 | |
| WO | WO2017214092 | | 12/2017 | |
| WO | WO2017220990 A1 | | 12/2017 | |
| WO | WO2018005706 | | 1/2018 | |
| WO | WO2018017863 | | 1/2018 | |
| WO | WO2018041838 | | 3/2018 | |
| WO | WO2018209304 A1 | | 11/2018 | |
| WO | WO2019050521 | | 3/2019 | |
| WO | WO2019104075 A1 | | 5/2019 | |
| WO | WO2019108863 A1 | | 6/2019 | |
| WO | WO2019173324 A1 | | 9/2019 | |
| WO | WO2019215453 A1 | | 11/2019 | |
| WO | WO2019224718 A2 | | 11/2019 | |
| WO | WO 2020023553 A1 | | 1/2020 | |
| WO | WO 2020033702 A1 | | 2/2020 | |
| WO | WO-2020146221 A1 | * | 7/2020 | ............ A61K 38/00 |
| WO | WO2020236797 A1 | | 11/2020 | |
| WO | WO2021026387 A2 | | 2/2021 | |

OTHER PUBLICATIONS

Clark LA, Demarest SJ, Eldredge J, Jarpe MB, Li Y, Simon K, van Vlijmen HW. Influence of canonical structure determining residues on antibody affinity and stability. J Struct Biol. Feb. 2014; 185(2):223-7. doi: 10.1016/j.jsb.2013.08.009. Epub Aug. 29, 2013. PMID: 23994046. (Year: 2014).*

Hummer AM, Abanades B, Deane CM. Advances in computational structure-based antibody design. Curr Opin Struct Biol. Jun. 2022;74:102379. doi: 10.1016/j.sbi.2022.102379. Epub Apr. 28, 2022. PMID: 35490649. (Year: 2022).*

Horita S, Nomura Y, Sato Y, Shimamura T, Iwata S, Nomura N. High-resolution crystal structure of the therapeutic antibody pembrolizumab bound to the human PD-1. Sci Rep. Oct. 13, 2016;6:35297. doi: 10.1038/srep35297. PMID: 27734966; PMCID: PMC5062252. (Year: 2016).*

Newsted D, et al. Blockade of TGF-8 signaling with novel synthetic antibodies limits immune exclusion and improves chemotherapy response in metastatic ovarian cancer models. Oncoimmunology. Nov. 20, 2018;8(2):e1539613.doi: 10.1080/2162402x.2018. 1539613. PMID:30713798; PMCID:PMC6343786. (Year: 2018).*

Chiu ML, et al. Antibody Structure and Function: The Basis for Engineering Therapeutics. Antibodies (Basel). Dec. 3, 2019; 8(4):55. doi: 10.3390/antib8040055. PMID:31816964; PMCID: PMC6963682. (Year: 2019).*

Janeway CA et al. Immunobiology: The Immune System in Health and Disease. 5th edition. NewYork: Garland Science; 2001. The structure of a typical antibody molecule. Available from: https:/Awww.ncbi.nim.nih.gov/books/NBK27144 (Year: 2001).*

Horita et al. High-resolution crystal structure of the therapeutic antibody pembrolizumab bound to the human PD-1. Sci Rep. Oct. 13, 2016;6:35297. doi: 10.1038/srep35297 (Year: 2016).*

Clark et al. Influence of canonical structure determining residues on antibody affinity and stability. J Struct Biol. Feb. 2014;185(2): 223-7. doi: 10.1016/j.jsb.2013.08.009 (Year: 2014).*

Koenig. Mutational landscape of antibody variable domains reveals a switch modulating the interdomain conformational dynamics and antigen binding. PNAS, E486-E4995, Jan. 5, 2017. (Year: 2017).*

Sela-Culang et al. The structural basis of antibody-antigen recognition. Fron. Immuno., vol. 4, Article 302, Oct. 2013. (Year: 2013).*

Herold et al. Determinants of the assembly and function of antibody variable domains. Nature Scientific Reports, 7:12276, Sep. 25, 2017. (Year: 2017).*

Alotaibi, F. et al., "Functional blocking of CD5 on T cells to enhance the efficacy of therapeutic PD-1 blockade in treatment of mouse 4T1 breat tumors." American Association for Cancer Research 2020, 1 page.

Alotaibi, F. et al., "CD5 blockade enhances ex vivo CD8+ T cell activation and tumour cell cytotoxicity." European Journal of Immunology vol. 50,5 (2020): 695-704.

Aykul, Senem, and Erik Martinez-Hackert. "Transforming Growth Factor-β Family Ligands Can Function as Antagonists by Competing for Type II Receptor Binding." The Journal of Biological Chemistry vol. 291,20 (2016): 10792-804.

Baardsnes, J et al., "TβR-II discriminates the high- and low-affinity TGF-beta isoforms via two hydrogen-bonded ion pairs." Biochemistry vol. 48,10 (2009): 2146-55.

Batlle, Eduard, and Joan Massagué. "Transforming Growth Factor-β Signaling in Immunity and Cancer." Immunity vol. 50,4 (2019): 924-940.

Bedinger, D. et al., "Development and characterization of human monoclonal antibodies that neutralize multiple TGFβ isoforms." mAbs vol. 8,2 (2016): 389-404.

Bernabeu, C. et al., "The emerging role of TGF-beta superfamily coreceptors in cancer." Biochimica et biophysica acta vol. 1792,10 (2009): 954-73.

Bierie, B. et al., "Abrogation of TGF-beta signaling enhances chemokine production and correlates with prognosis in human breast cancer." The Journal of clinical investigation vol. 119,6 (2009): 1571-82.

Biswas, T. et al., "Attenuation of TGF-β signaling supports tumor progression of a mesenchymal-like mammary tumor cell line in a syngeneic murine model." Cancer letters vol. 346,1 (2014): 129-38.

Boutet, M. et al., "TGFβ Signaling Intersects with CD103 Integrin Signaling to Promote T-Lymphocyte Accumulation and Antitumor Activity in the Lung Tumor Microenvironment." Cancer research vol. 76,7 (2016): 1757-69.

Budhu, S. et al., "Blockade of surface-bound TGF-β on regulatory T cells abrogates suppression of effector T cell function in the tumor microenvironment." Science signaling vol. 10,494. eaak9702 (2017).

Calon, A et al., "TGF-beta in CAF-mediated tumor growth and metastasis." Seminars in cancer biology vol. 25 (2014): 15-22.

Calon, A. et al., "Dependency of colorectal cancer on a TGF-β -driven program in stromal cells for metastasis initiation." Cancer cell vol. 22,5 (2012): 571-84.

Calon, A. et al., "Stromal gene expression defines poor-prognosis subtypes in colorectal cancer." Nature genetics vol. 47,4 (2015): 320-9.

Campbell, M. et al., "Cryo-EM Reveals Integrin-Mediated TGF-β Activation without Release from Latent TGF-β." Cell vol. 180,3 (2020): 490-501.

Case, K. et al., "TNFR2 blockade alone or in combination with PD-1 blockade shows therapeutic efficacy in murine cancer models." Journal of leukocyte biology vol. 107,6 (2020): 981-991.

Chakravarthy, Ankur et al., "TGF-β-associated extracellular matrix genes link cancer-associated fibroblasts to immune evasion and immunotherapy failure with supplementary data." Nature communications vol. 9, (2018):4692, 25 pages.

Chen, S. et al., "CD73 expression on effector T cells sustained by TGF-β facilitates tumor resistance to anti-4-1BB/CD137 therapy." Nature communications vol. 10,1 (2019):150, 15 pages.

Chen, X. et al., "Effective chemoimmunotherapy with anti-TGFβ antibody and cyclophosphamide in a mouse model of breast cancer." PloS one vol. 9,1 (2014):e85398.

Dahmani, Amina, and Jean-Sébastien Delisle. "TGF-β in T Cell Biology: Implications for Cancer Immunotherapy." Cancers vol. 10,194 (2018):1-21.

David, J. et al., "A novel bifunctional anti-PD-L1/TGF-β Trap fusion protein (M7824) efficiently reverts mesenchymalization of human lung cancer cells." Oncoimmunology vol. 6,10 (2017): e1349589-1-e1349589-4.

De Crescenzo, G. et al., "Three key residues underlie the differential affinity of the TGFbeta isoforms for the TGFbeta type II receptor." Journal of molecular biology vol. 355,1 (2006): 47-62.

Derynck, R et al., "TGFβ biology in cancer progression and immunotherapy." Nature reviews. Clinical oncology vol. 18,1 (2020): 9-34.

Derynck, Rik, and Erine H Budi. "Specificity, versatility, and control of TGF-β family signaling." Science signaling vol. 12,570 (2019):eaav5183, 24 pages.

(56) References Cited

OTHER PUBLICATIONS

El-Asady, Riham et al., "TGF-β-dependent CD103 expression by CD8(+) T cells promotes selective destruction of the host intestinal epithelium during graft-versus-host disease." The Journal of experimental medicine vol. 201,10 (2005): 1647-57.
Farrington, D. et al., "Development and validation of a phosphorylated SMAD ex vivo stimulation assay." Biomarkers: biochemical indicators of exposure, response, and susceptibility to chemicals vol. 12,3 (2007): 313-30.
Formenti, S et al., "Focal Irradiation and Systemic TGFBβ Blockade in Metastatic Breast Cancer." Clinical cancer research: an official journal of the American Association for Cancer Research vol. 24, 11 (2018): 2493-2504.
Grauel, A et al., "TGFβ-blockade uncovers stromal plasticity in tumors by revealing the existence of a subset of interferon-licensed fibroblasts and supplementary data." Nature communications vol. 11,1 (2020): 6315, 30 pages.
Groppe, J. et al., "Cooperative assembly of TGF-beta superfamily signaling complexes is mediated by two disparate mechanisms and distinct modes of receptor binding." Molecular cell vol. 29,2 (2008): 157-68.
Grütter, C. et al., "A cytokine-neutralizing antibody as a structural mimetic of 2 receptor interactions." Proceedings of the National Academy of Sciences of the United States of America vol. 105,51 (2008): 20251-6.
Gulley, J. et al., "Preliminary results from a phase 1 trial of M7824 (MSB0011359C), a bifunctional fusion protein targeting PD-L1 and TGF-β, in advanced solid tumors." ASCO Annual Meeting (2017), 22 pages.
Hagopian, Moriah M, and Rolf A Brekken. "Stromal TGFβR2 signaling: a gateway to progression for pancreatic cancer." Molecular and cellular oncology vol. 2,3 (2014): e975606-1-e975606-3.
Han, B. et al., "Altered NKp30, NKp46, NKG2D, and DNAM-1 Expression on Circulating NK Cells Is Associated with Tumor Progression in Human Gastric Cancer." Journal of immunology research vol. 2018 (2018): 6248590, 9 pages.
Heldin, C. et al., "TGF-beta signalling from cell membrane to nucleus through SMAD proteins." Nature vol. 390,6659 (1997): 465-71.
Huang, H. et al., "Targeting TGFβR2-mutant tumors exposes vulnerabilities to stromal TGFβ blockade in pancreatic cancer." EMBO molecular medicine vol. 11,11 (2019): e10515.
Huang, T. et al., "TGF-β signalling is mediated by two autonomously functioning TβRI:TβRII pairs." The EMBO journal vol. 30,7 (2011): 1263-76.
Jiao, S. et al., "Differences in Tumor Microenvironment Dictate T Helper Lineage Polarization and Response to Immune Checkpoint Therapy." Cell vol. 179,5 (2019): 1177-1190.
Jochems, C. et al., "Analyses of functions of an anti-PD-L1/TGFβR2 bispecific fusion protein (M7824)." Oncotarget vol. 8,43 (2017): 75217-75231.
Joyce, J. "Therapeutic targeting of the tumor microenvironment." Cancer cell vol. 7,6 (2005): 513-20.
Katsuno, Yoko et al., "Chronic TGF-β exposure drives stabilized EMT, tumor stemness, and cancer drug resistance with vulnerability to bitopic mTOR inhibition." Science signaling vol. 12,570 eaau8544 (2019):1-17.
Klitgaard, J. et al., "Combination of two anti-CD5 monoclonal antibodies synergistically induces complement-dependent cytotoxicity of chronic lymphocytic leukaemia cells." British journal of haematology vol. 163,2 (2013): 182-93.
Kloss, C. et al., "Dominant-Negative TGF-β Receptor Enhances PSMA-Targeted Human Car T Cell Proliferation And Augments Prostate Cancer Eradication." Molecular therapy : the journal of the American Society of Gene Therapy vol. 26,7 (2018): 1855-1866.
Knudson, K. et al., "M7824, a novel bifunctional anti-PD-L1/TGFβ Trap fusion protein, promotes anti-tumor efficacy as monotherapy and in combination with vaccine with supplemental data." Oncoimmunology vol. 7,5 (2018): e1426519-1-e1426519-14.
Lacouture, M. et al., "Cutaneous keratoacanthomas/squamous cell carcinomas associated with neutralization of transforming growth factor β by the monoclonal antibody fresolimumab (GC1008)." Cancer immunology, immunotherapy : CII vol. 64,4 (2015): 437-446.
Lan, Yan et al., "Enhanced preclinical antitumor activity of M7824, a bifunctional fusion protein simultaneously targeting PD-L1 and TGF-β." Science translational medicine vol. 10,424 (2018): eaan5488, 15 pages.
Leask, Andrew, and David J Abraham. "TGF-beta signaling and the fibrotic response." FASEB journal: official publication of the Federation of American Societies for Experimental Biology vol. 18,7 (2004): 816-27.
Li, S et al., "Cancer immunotherapy via targeted TGF-β signalling blockade in TH cells." Nature vol. 587,7832 (2020): 121-125.
Liang, X. et al., "Anti-TGF-β Antibody, 1D11, Ameliorates Glomerular Fibrosis in Mouse Models after the Onset of Proteinuria." PloS one vol. 11,5 e0155534 (2016):1-17.
Liu, J et al., "TGF-β blockade improves the distribution and efficacy of therapeutics in breast carcinoma by normalizing the tumor stroma." Proceedings of the National Academy of Sciences of the United States of America vol. 109,41 (2012): 16618-23.
Lonning, Scott et al., "Antibody targeting of TGF-β in cancer patients." Current pharmaceutical biotechnology vol. 12, 12 (2011): 2176-2189.
López-Casillas, F. et al., "Betaglycan can act as a dual modulator of TGF-beta access to signaling receptors: mapping of ligand binding and GAG attachment sites." The Journal of cell biology vol. 124,4 (1994): 557-568.
Lord, D. et al., "Structure-based engineering to restore high affinity binding of an isoform-selective anti-TGFβ1 antibody." mAbs vol. 10,3 (2018): 444-452.
Mariathasan, S. et al., "TGFβ attenuates tumour response to PD-L1 blockade by contributing to exclusion of T cells." Nature vol. 554,7693 (2018): 544-548.
Marwitz, S. et al., "Phosphorylation of SMAD3 in immune cells predicts survival of patients with early stage non-small cell lung cancer." Journal for immunotherapy of cancer vol. 9,2 e001469 (2021): 1-11.
Massagué, J. "TGFbeta in Cancer." Cell vol. 134,2 (2008): 215-230.
Massagué, J. "TGFβ signalling in context." Nature reviews. Molecular cell biology vol. 13,10 (2012): 616-630.
McGaraughty, S. et al., "Targeting Anti-TGF-β Therapy to Fibrotic Kidneys with a Dual Specificity Antibody Approach." Journal of the American Society of Nephrology: JASN vol. 28,12 (2017): 3616-3626.
Miao, Y. et al., "Adaptive Immune Resistance Emerges from Tumor-Initiating Stem Cells." Cell vol. 177,5 (2019): 1172-1186.
Mokrani, M. et al., "Smad and NFAT pathways cooperate to induce CD103 expression in human CD8 T lymphocytes." Journal of immunology vol. 192,5 (2014): 2471-9.
Morris, J. et al., "Phase I Study of GC1008 (Fresolimumab): A Human Anti-Transforming Growth Factor-Beta (TGFb) Monoclonal Antibody in Patients with Advanced Malignant Melanoma or Renal Cell Carcinoma." PLOS One vol. 9,3 e90353 (2014): 1-11.
Moulin, A. et al., "Structures of a pan-specific antagonist antibody complexed to different isoforms of TGFβ reveal structural plasticity of antibody-antigen interactions." Protein science: a publication of the Protein Society vol. 23,12 (2014): 1698-707.
Muraoka, R. et al., "Blockade of TGF-beta inhibits mammary tumor cell viability, migration, and metastases." The Journal of clinical investigation vol. 109,12 (2002): 1551-9.
Neuzillet, C. et al., "Perspectives of TGF-β inhibition in pancreatic and hepatocellular carcinomas." Oncotarget vol. 5,1 (2014): 78-94.
Neuzillet, C. et al., "Targeting the TGFβ pathway for cancer therapy." Pharmacology & therapeutics vol. 147 (2015): 22-31.
Ostapoff, Katherine T et al., "Neutralizing murine TGFβR2 promotes a differentiated tumor cell phenotype and inhibits pancreatic cancer metastasis." Cancer research vol. 74,18 (2014): 4996-5007.
Park, B. et al., "TGFβ1-Mediated SMAD3 Enhances PD-1 Expression on Antigen-Specific T Cells in Cancer." Cancer discovery vol. 6, 12 (2016): 1366-1381.

(56) References Cited

OTHER PUBLICATIONS

Qian, S. et al., "Binding affinity of transforming growth factor-beta for its type II receptor is determined by the C-terminal region of the molecule." The Journal of biological chemistry vol. 271,48 (1996): 30656-62.
Qin, T. et al., "A novel highly potent trivalent TGF-β receptor trap inhibits early-stage tumorigenesis and tumor cell invasion in murine Pten-deficient prostate glands." Oncotarget vol. 7,52 (2016): 86087-86102.
Ravi, Rajani et al., "Bifunctional immune checkpoint-targeted antibody-ligand traps that simultaneously disable TGFβ enhance the efficacy of cancer immunotherapy with supplemental data." Nature communications vol. 9,1 741 (2018): 1-21.
Rifkin, D. "Latent transforming growth factor-beta (TGF-beta) binding proteins: orchestrators of TGF-beta availability." The Journal of biological chemistry vol. 280,9 (2005): 7409-12.
Scholar Rock "From New Insights to New Medicines." 37th Annual J.P. Morgan Healthcare Conference, Jan. 2019, 33 pages. (2019).
Shi, Yigong, and Joan Massagué. "Mechanisms of TGF-beta signaling from cell membrane to the nucleus." Cell vol. 113,6 (2003): 685-700.
Stauber, A. et al., "Nonclinical Safety Evaluation of a Transforming Growth Factor β Receptor I Kinase Inhibitor in Fischer 344 Rats and Beagle Dogs." Journal of Clinical Toxicology 4 (2014): 1-10.
Stevenson, J. et al., "Immunological effects of the TGFβ-blocking antibody GC1008 in malignant pleural mesothelioma patients." Oncoimmunology vol. 2,8 e26218 (2013): 1-10.
Strauss, J. et al., "Phase I Trial of M7824 (MSB0011359C), a Bifunctional Fusion Protein Targeting PD-L1 and TGFβ, in Advanced Solid Tumors." Clinical cancer research: an official journal of the American Association for Cancer Research vol. 24,6 (2018): 1287-1295.
Strauss, L. et al., "Targeted deletion of PD-1 in myeloid cells induces antitumor immunity." Science immunology vol. 5,43 eaay1863 (2020): 1-14.
Takahashi, H. et al., "Cancer-associated fibroblasts promote an immunosuppressive microenvironment through the induction and accumulation of protumoral macrophages." Oncotarget vol. 8,5 (2017): 8633-8647.
Takasaka, N. et al., "Integrin αvβ8-expressing tumor cells evade host immunity by regulating TGF-β activation in immune cells." JCI insight vol. 3,20 e122591 (2018):1-47.
Tang, N. et al., "TGF-β inhibition via CRISPR promotes the long-term efficacy of CAR T cells against solid tumors." JCI insight vol. 5,4 e133977 (2020): 1-17.
Tauriello, D. et al., "Overcoming TGFβ-mediated immune evasion in cancer." Nature reviews. Cancer vol. 22,1 (2021): 25-44.
Tauriello, D. et al., "TGFβ drives immune evasion in genetically reconstituted colon cancer metastasis." Nature vol. 554,7693 (2018): 538-543.
Teixeira, A. et al., "On-Target Anti-TGF-β Therapies Are Not Succeeding in Clinical Cancer Treatments: What Are Remaining Challenges?." Frontiers in cell and developmental biology vol. 8 605. (2020): 1-18.
Thomas, D., and J. Massagué. "TGF-beta directly targets cytotoxic T cell functions during tumor evasion of immune surveillance." Cancer cell vol. 8,5 (2005): 369-80.
Tolcher, A. et al., "A phase 1 study of anti-TGFβ receptor type-II monoclonal antibody LY3022859 in patients with advanced solid tumors." Cancer chemotherapy and pharmacology vol. 79,4 (2017): 673-680.
Trachtman, H. et al., "A phase 1, single-dose study of fresolimumab, an anti- TGF-β antibody, in treatment-resistant primary focal segmental glomerulosclerosis." Kidney international vol. 79,11 (2011): 1236-43.
Tu, E. et al., "T Cell Receptor-Regulated TGF-β Type I Receptor Expression Determines T Cell Quiescence and Activation." Immunity vol. 48,4 (2018): 745-759.
Vincenti, F. et al., "A Phase 2, Double-Blind, Placebo-Controlled, Randomized Study of Fresolimumab in Patients With Steroid-Resistant Primary Focal Segmental Glomerulosclerosis." Kidney international reports vol. 2,5 (2017):800-810.
Voelker, J. et al., "Anti-TGF-β1 Antibody Therapy in Patients with Diabetic Nephropathy." Journal of the American Society of Nephrology : JASN vol. 28,3 (2017): 953-962.
Wan, Y., and R. Flavell. "'Yin-Yang' functions of transforming growth factor-beta and T regulatory cells in immune regulation." Immunological reviews vol. 220 (2007): 199-213.
Yang, Y. et al., "The Outcome of TGFβ Antagonism in Metastatic Breast Cancer Models In Vivo Reflects a Complex Balance between Tumor-Suppressive and Proprogression Activities of TGFβ." Clinical cancer research : an official journal of the American Association for Cancer Research vol. 26,3 (2020): 643-656.
Yi, M. et al., "Combine and conquer: manganese synergizing anti-TGF-β/PD-L1 bispecific antibody YM101 to overcome immunotherapy resistance in non-inflamed cancers." Journal of hematology & oncology vol. 14, 146 (2021):1-21.
Yi, M. et al., "The construction, expression, and enhanced anti-tumor activity of YM101: a bispecific antibody simultaneously targeting TGF-β and PD-L1." Journal of hematology & oncology vol. 14,1 27 (2021):1-22.
Zhao, F. et al., "Stromal Fibroblasts Mediate Anti-PD-1 Resistance via MMP-9 and Dictate TGFβ Inhibitor Sequencing in Melanoma." Cancer immunology research vol. 6,12 (2018): 1459-1471.
Zhong, Z. et al., "Anti-transforming growth factor beta receptor II antibody has therapeutic efficacy against primary tumor growth and metastasis through multieffects on cancer, stroma, and immune cells." Clinical cancer research : an official journal of the American Association for Cancer Research vol. 16,4 (2010): 1191-205.
Zhou, C. et al., "A targeted transforming growth factor-beta (TGF-β) blocker, TTB, inhibits tumor growth and metastasis." Oncotarget vol. 9,33 (2018):23102-23113.
Zhu, H. et al., "A Novel TGFβ Trap Blocks Chemotherapeutics-Induced TGFβ1 Signaling and Enhances Their Anticancer Activity in Gynecologic Cancers." Clinical cancer research : an official journal of the American Association for Cancer Research vol. 24, 12 (2018): 2780-2793.
Zwaagstra, J. et al., "Engineering and therapeutic application of single-chain bivalent TGF-β family traps." Molecular cancer therapeutics vol. 11,7 (2012): 1477-87.
Zwaagstra, J. et al., "Single-chain receptor ectodomain-based TGF-β traps as an alternative to therapeutic antibodies." PepTalk 2011, San Diego CA (2011), 1 page.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.

(56) References Cited

OTHER PUBLICATIONS

Aplin et al., , Preparation, properties, and applications of carbohydrate conjugates of proteins and lipids, 1981, CRC Crit. Rev. Biochem., pp. 259-306.
Arnett, et al., Crystal structure of a human CD3-ϵ/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.

(56) References Cited

OTHER PUBLICATIONS

Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCyRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (Seed) $C_{H3}$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization Of Therapeutic Proteins By T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
Digiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transi Med. Nov. 12, 2014:6(262):262ra155. doi: 10.1126/scitransimed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the $\alpha$- and $\beta$-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcyRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3$\epsilon$ Subunits within a T Cell Receptor Complex Lies in Close Proximity to the C$\beta$ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: lon-Exchange Chromatography.", Methods Mol Biol 2010 ;588:27-32.

(56) References Cited

OTHER PUBLICATIONS

Gunasekaran et al., Enhancing Antibody Fc Heterodimer Formation through Electrostatic Steering Effects, Journal of Biological Cheminstry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$- Segments in the Preferential Reassociation of Immunoglobulin Subunits, Molecular Immunology, 1986, vol. 23, No. 5, pp. 503-510.
HAwkins et al., Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$CH_3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H$/$V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcyR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay., Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 2, 20133;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014; 1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.

(56) References Cited

OTHER PUBLICATIONS

Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications. ", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi: 10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Link, et al., Production and Characterization of a Bispecific IgG Capable of Inducing T-Cell-Mediated Lysis of Malignant B Cells, Blood, 1993, vol. 81, No., 12, pp. 3343-3349.
Link, et al., Production and Characterization ofa Bispecifc IgG Capable of Inducing T-Cell-Mediated Lysis of Malignant B Cells, Blood, 1993, vol. 81, No, 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al., Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins o'1 effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J. Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

(56) References Cited

OTHER PUBLICATIONS

MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al., Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PloS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al., Phase I trial and tumour localization of the anti-EGFR monoclonal antibody ICR62 in head and neck or lung cancer, 1996, Br J Cancer, 73(2):228-35.
Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):09.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.

(56) References Cited

OTHER PUBLICATIONS

O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-ϵ) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (-)-dolastatin 10.1 X-ray molecular structure of N, N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering, 1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Rothlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp 76-136, 1965, Academic Press.
Senter et al., Proceedings of the American Association for Cancer Research, 2004, vol. 45, Abstract No. 623.

(56) References Cited

OTHER PUBLICATIONS

Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998; 102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human a/B T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcyRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcy receptor structural and functional diversity., Proc Natl Acad Sci U S A. Apr. 17, 2012;109(16):6181-6. doi: 10.1073/pnas.1203954109. Epub Apr. 2, 2012.
Soumyarani et al., Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi: 10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi: 10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., Aaps J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.
Tarcsa et al., Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi: 10.1093/glycob/cwn116.
Van Boxel, et al., Some lessons from the systematic production and structural analysis of soluble αβ T-cell receptors, Journal of Immunological Methods, 2009, vol. 350, pp. 14-21.

(56) References Cited

OTHER PUBLICATIONS

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcy Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wigginton et al., An immunoglobulin E-reactive chimeric human immunoglobulin G1 anti-idiotype inhibits basophil degranulation through cross-linking of FcϵRI with FcγRIIb., Clinical & Experimental Allergy, 38: 313-319.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein vol. in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.

(56) References Cited

OTHER PUBLICATIONS

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Zhang et al., The development of bispecific antibodies and their applications in tumor immune escape., Experimental Hematology & Oncology20176:12.

Krupka et al., Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.

Fos et al., ICOS ligation recruits the p50alpha PI3K regulatory subunit to the immunological synapse., J Immunol. Aug. 1, 2008;181(3):1969-77.

Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol.2015.05.014. Epub Jun. 11, 2015.

Vieira et al., ICOS-mediated signaling regulates cytokine production by human T cells and provides a unique signal to selectively control the clonal expansion of Th2 helper cells., Eur J Immunol. May 2004;34(5):1282-90.

Madrenas et al., Conversion of CTLA-4 from inhibitor to activator of T cells with a bispecific tandem single-chain Fv ligand., J Immunol. May 15, 2004;172(10):5948-56.

Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.

Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.

Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.

Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.

Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.

Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.

Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.

Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.

Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.

Shields et al; "High Resolution Mapping of the Binding Site on Human IgG 1 for FcyRI, FcyRII, FcyRIII, and FcRn and Design of IgG1 Variants with Improved Binding to the FcyR*", The Journal of Biological Chemistry, 2001, 276(2):6591-6604.

Szymkowski et al; " Anti-CD38—anti-CD3 bispecific antibody in multiple myeloma" , Xencor, pp. 1-15. Mar. 28, 2014.

Julg, B. et al."Enhanced Anti-HIV Functional Activity Associated with Gag-Specific CD8 T-Cell Responses." Journal of Virology 84.11 (2010): 5540-5549. Mar. 24, 2010.

Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1) 60-69.

Armour et al., Recombinant human IgG molecules lacking FcY receptor I binding and monocyte triggering activities., Eur. J. Immunol. 1999. 29: 2613-2624.

Bogolyubova et al. , Cancer immunotherapy based on the blockade of immune checkpoints, Oct. 2015, Medical Immunology (Russia) 17(5):395.

Schanzer et al., "A Novel Glycoengineered Bispecific Antibody Format for Targeted Inhibition of Epidermal Growth Factor Receptor (EGFR) and Insulin-like Growth Factor Receptor Type I (IGF-1 R) Demonstrating Unique Molecular Properties", Journal of Biological Chemistry, vol. 289, No. 27, May 19, 2014 (May 19, 2014), pp. 18693-18706.

Volker Baum et al, "Antitumor activities of PSMA x CD3 diabodies by redirected T-cell lysis of prostate cancer cells", Immunotherapy, vol. 5, No. 1, pp. 27-38, Jan. 31, 2013.

Stewart et al., "The role of Fc gamma receptors in the activity of immunomodulatory antibodies for cancer", Journal for Immunotherapy of Cancer, Biomed Central, London, UK, vol. 2, No. 1, Aug. 19, 2014 (Aug. 19, 2014), p. 29.

Moore et al., A robust heterodimeric Fc platform engineered for efficient development of bispecific antibodies of multiple formats., Methods. Feb. 1, 2019;154:38-50. doi:10.1016/j.ymeth.2018.10.006. Epub Oct. 23, 2018.

Celine Monnet et al: "Selection of IgG variants with increased FcRn binding using random and directed mutagenesis: impact on effector functions", Frontiers in Immunology, vol. 6, No. 39, Feb. 4, 2015 (Feb. 4, 2015), pp. 1-14, XP055238838, DOI: 10.3389/fimmu.2015.00039.

Sondermann Peter et al: "Harnessing Fe receptor biology in the design of therapeutic antibodies", Current Opinion in Immunology, Elsevier, Oxford, GB, vol. 40, Mar. 30, 2016 (Mar. 30, 2016), pp. 78-87, XP029551351, ISSN: 0952-7915, DOI: 10.1016/J.COI.2016.03.005.

Deckert et al., "A Novel Humanized CD38-Targeting Antibody, Demonstrates Potent Antitumor Activity in Models of Multiple Myeloma and Other CD38+ Hematologic Malignancies", Clinical Cancer Research, vol. 20, No. 17, pp. 4574-4583 (Sep. 2014).

De Weers et al., "Daratumumab, a Novel Therapeutic Human CD38 Monoclonal Antibody, Induces Killing of Multiple Myeloma and Other Hematological Tumors", The Journal of Immunology, vol. 186, No. 3, pp. 1840-1848 (Dec. 2010).

(56) References Cited

OTHER PUBLICATIONS

Wang et al., Comparison of Biologic Activity of Two Anti-PSA/Anti-CD3 Bispecific Singlechain Antibodies, National Journal of Andrology, vol. 13(1), pp. 8-12 (2007).
Wu et al., Fab-based bispecific antibody formats with robust biophysical properties and biological activity. mAbs, 7:3, 470-482, Published online: May 1, 2015.
Holliger et al., Engineered antibody fragments and the rise of single domains., Nature Biotechnology, vol. 23, pp. 1126-1136 (2005).
Reusch U et al Anti-CD3 x anti-epidermal growth factor receptor (EGFR) bispecific antibody redirects T-cell cytolytic activity to EGFRpositive cancers in vitro and in an animal model, Clinical Cancer Research, The American Association for Cancer Research, US, vol. 12, No. 1, Jan. 1, 2006 (Jan. 1, 2006), pp. 183-190.
Roland Kontermann: "Dual targeting strategies with bispecific antibodies", mAbs, vol. 4, No. 2, Mar. 1, 2012 (Mar. 1, 2012), pp. 182-197, XP055566203.
Kontermann Rolande: "Recombinant bispecific antibodies for cancer therapy", Acta Pharmacologica Sinica, vol. 26, No. 1, Jan. 1, 2005 (Jan. 1, 2005), pp. 1-9, XP002426874.
Steffen Dickopf et al, "Format and geometries matter: Structure-based design defines the functionality of bispecific antibodies", *Computational and Structural Biotechnology Journal*, vol. 18, May 14, 2020 (May 14, 2020), p. 1221-1227.
Roda-Navarro Pedro et al, "Understanding the Spatial Topology of Artificial Immunological Synapses Assembled in T Cell-Redirecting Strategies: A Major Issue in Cancer Immunotherapy", Frontiers in Cell and Developmental Biology, vol. 7, Jan. 10, 2020 (Jan. 10, 2020).
Suurs Frans V et al, "A review of bispecific antibodies and antibody constructs in oncology and clinical challenges", Apr. 24, 2019 (Apr. 24, 2019), vol. 201, p. 103-119.
Chen Shixue et al, "Immunoglobulin Gamma-Like Therapeutic Bispecific Antibody Formats for Tumor Therapy", US Feb. 11, 2019 (Feb. 11, 2019), vol. 2019, p. 1-13.
Thomas Van Blarcom et al, "Productive common light chain libraries yield diverse panels of high affinity bispecific antibodies", MABS, vol. 10, No. 2, Dec. 14, 2017 (Dec. 14, 2017), p. 256-268.
Hedvat Michael et al, "697—Tumor-targeted CD28 costimulatory bispecific antibodies enhance T cell activation in solid tumors", Journal for Immunotherapy of Cancer, vol. 8, No. Suppl 3, Nov. 1, 2020 (Nov. 1, 2020), p. A739-A739.
Correnti Colin E et al: "Simultaneous multiple interaction T-cell engaging (SMITE) bispecific antibodies overcome bispecific T-ce11 engager (BiTE) resistance via CD28 co-stimulation", Leukemia, Nature Publishing Group UK, London, vol. 32, No. 5, Jan. 31, 2018 (Jan. 31, 2018), pp. 1239-1243.
Correnti, Colin E. et al: Supplemental Methods Simultaneous multiple interaction T-ce11 engaging (SMITE) bispecific antibodies overcome bispecific T-cell engager (BiTE) resistance via CD28 co-stimulation, Leukemia, Jan. 31, 2018 (Jan. 31, 2018), pp. 1-7, XP055656259, DOI: 10.1038/s41375-018-0014-3 Retrieved from the Internet: URL:doi:10.1038/s41375-018-0014- [retrieved on Jan. 9, 2020].
Brinkmann et al: The making of bispecific antibodies., MABS, vol. 9, No. 2, Jan. 10, 2017 (Jan. 10, 2017), pp. 182-212.
Moore Gregory L et al: "Abstract 1880: PDLI-targeted CD28 costimulatory bispecific antibodies enhance T cell activation in solid tumors", Cancer Research, Jul. 1, 2021 (Jul. 1, 2021), XP055881520, Retrieved from the Internet: URL:https://cancerres.aacrjournals.org/content/81/13_Supplement/1880.
Moore Gregory L et al: "PDLI-targeted CD28 costimulatory bispecific antibodies enhance T cell activation in solid tumors", Jul. 1, 2021 (Jul. 1, 2021), XP055881523, Retrieved from the Internet: URL:https://investors.xencor.com/static-files/5adc4e21-6760-4eec-b7b3-f2b6765bddc3.
Tolcher Anthony W. et al.: "A phase 1 study of anti-TGF[beta] receptor type-II monoclonal antibody LY3022859 in patients with advanced solid tumors", Cancer Chemotherapy and Pharmacology, Springer Verlag, Berlin, DE, vol. 79, No. 4, Mar. 9, 2017 (Mar. 9, 2017), pp. 673-680, XP036196406.
Moore Gregory et al: "714—PD1 x TGF[beta]R2 bispecifics selectively block TGF[beta]R2 on PDI-positive T cells, promote T cell activation, and elicit an anti-tumor response in solid tumors", Journal for Immunotherapy of Cancer, vol. 8, No. Suppl 3, Nov. 9, 2020 (Nov. 9, 2020), pp. A756-A756.
Moore Gregory et al: Abstract #714 "PD1 x TGF[beta]R2 bispecifics selectively block TGF[beta]R2 on PDI-positive T cells, promote T cell activation, and elicit an anti-tumor response in solid tumors", Journal for immunotherapy of cancer, Nov. 9, 2020 (Nov. 9, 2020), pp. A756-A756, XP055884418, London DOI: 10.1136/jitc-2020-SITC2020.0714 Retrieved from the Internet: URL:https://investors.xencor.com/static-files/abballc4-fe9a-4152a209-88c0d55c3906 [retrieved on Jan. 27, 2022].
Brinkmann et al., Cloning and expression of the recombinant FAb fragment of monoclonal antibody K1 that reacts with mesothelin present on mesotheliomas and ovarian cancers., Int J Cancer. May 16, 1997;71(4):638-44.
Stadler et al., Elimination of large tumors in mice by mRNA-encoded bispecific antibodies., Nat Med. Jul. 2017;23(7):815-817. doi: 10.1038/nm.4356. Epub Jun. 12, 2017.

* cited by examiner

Figure 1A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 1B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 1C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 1D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| Y349C | S354C |

Figure 1E

| **Monomer 1** | **Monomer 2** |
|---|---|
| T366S/L368A/Y407V/Y349C | T366W/S354C |
| T366S/L368A/Y407V/S354C | T366W/Y349C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 2

| Variant constant region | Substitutions |
|---|---|
| pI-ISO(-) | I199T/N203D/K274Q/R355Q/N384S/K392N/N397M/Q419E/K447_ |
| pI_ISO(-)-Fc only | K274Q/R355Q/N384S/K392N/V397M/Q419E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 3

| **Ablation Variants** | | | |
|---|---|---|---|
| G236R | 299R | P329H | G236R/L328R |
| S239G | 299K | P329K | E233P/L234V/L235A/G236_/S239K |
| S239K | K322A | A330L | E233P/L234V/L235A/G236_/S267K |
| S239Q | A327G | A330S/P331S | E233P/L234V/L235A/G236_/S239K/A327G |
| S239R | A327L | I332K | E233P/L234V/L235A/G236_/S267K/A327G |
| V266D | A327N | I332R | E233P/L234V/L235A/G236_ |
| S267K | A327Q | V266D/A327Q | S239K/S267K |
| S267R | L328E | V266D/P329K | 267K/P329K |
| H268K | L328R | S267R/A327Q | |
| E269R | P329A | S267R/P329K | |

Figure 4

| **Heavy Chain 1 (-)** | **Heavy Chain 2 (+)** |
|---|---|
| ±C220S | ±C220S |
| Heterodimer pI variants L368D/K370S | Heterodimer pI variants S364K/E357Q |
| Isosteric pI substitutions N208D/Q295E/N384D/Q418E/N421D *note: there is no N208D in constructs that do not have a CH1 | |
| FcKO E233P/L234V/L235A/G236_/S267K | FcKO E233P/L234V/L235A/G236_/S267K |
| ±M428L/N434S | ±M428L/N434S |

Figure 5

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 1758 |
| Whitlow linker | GSTSGSGKPGSGEGSTKG | 18 | +1 | 1759 |
| 6paxA_1 (+A) | IRPRAIGGSKPRVA | 14 | +4 | 1760 |
| +B | GKGGSGKGGSGKGGS | 15 | +3 | 1761 |
| +C | GGKGSGGKGSGGKGS | 15 | +3 | 1762 |
| +D | GGGKSGGGKSGGGKS | 15 | +3 | 1763 |
| +E | GKGKSGKGKSGKGKS | 15 | +6 | 1764 |
| +F | GGGKSGGKGSGKGGS | 15 | +3 | 1765 |
| +G | GKPGSGKPGSGKPGS | 15 | +3 | 1766 |
| +H | GKPGSGKPGSGKPGSGKPGS | 20 | +4 | 1767 |
| +I | GKGKSGKGKSGKGKSGKGKS | 20 | +8 | 1768 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 1769 |
| 3hsc_2 (-A) | STAGDTHLGGEDFD | 14 | -4 | 1770 |
| -B | GEGGSGEGGSGEGGS | 15 | -3 | 1771 |
| -C | GGEGSGGEGSGGEGS | 15 | -3 | 1772 |
| -D | GGGESGGGESGGGES | 15 | -3 | 1773 |
| -E | GEGESGEGESGEGES | 15 | -6 | 1774 |
| -F | GGGESGGEGSGEGGS | 15 | -3 | 1775 |
| -G | GEGESGEGESGEGESGEGES | 20 | -8 | 1776 |

Additional scFv Linkers

| | |
|---|---|
| GGGGSGGGGSGGGGS | SEQ ID NO:1758 |
| GGGGSGGGGSGGGGSGGGGS | SEQ ID NO:1769 |
| GSTSGSGKPGSGEGSTKG | SEQ ID NO:1759 |
| PRGASKSGSASQTGSAPGS | SEQ ID NO:1777 |
| GTAAAGAGAAGGAAAGAAG | SEQ ID NO:1778 |
| GTSGSSGSGSGGSGSGGGG | SEQ ID NO:1779 |
| GKPGSGKPGSGKPGSGKPGS | SEQ ID NO:1767 |

Figure 6

Useful domain linkers

| Name | Sequence | SEQ ID NO: |
|---|---|---|
| $(GGGGS)_1$ or GGGGS | GGGGS | 1780 |
| $(GGGGS)_2$ | GGGGSGGGGS | 1781 |
| $(GGGGS)_3$ | GGGGSGGGGSGGGGS | 1758 |
| $(GGGGS)_4$ | GGGGSGGGGSGGGGSGGGGS | 1769 |
| $(GGGGS)_5$ | GGGGSGGGGSGGGGSGGGGSGGGGS | 1782 |
| $(GGGGS)_6$ | GGGGSGGGGSGGGGSGGGGSGGGGSGGGGS | 1783 |
| $(GGGGS)_7$ | GGGGSGGGGSGGGGSGGGGSGGGGSGGGGSGGGGS | 1784 |
| $(GGGGA)_1$ or GGGGA | GGGGA | 1785 |
| $(GGGGA)_2$ | GGGGAGGGGA | 1786 |
| $(GGGGA)_3$ | GGGGAGGGGAGGGGA | 1787 |
| $(GGGGA)_4$ | GGGGAGGGGAGGGGAGGGGA | 1788 |
| $(GGGGA)_5$ | GGGGAGGGGAGGGGAGGGGAGGGGA | 1789 |
| $(GGGGA)_6$ | GGGGAGGGGAGGGGAGGGGAGGGGAGGGGA | 1790 |
| $(GGGGA)_7$ | GGGGAGGGGAGGGGAGGGGAGGGGAGGGGAGGGGA | 1791 |
| 30AA-linker | DPALVHQRPAPPGGGGSGGGGSGGGGSGGG | 1792 |
| $(GKPGS)_1$ or GKPGS | GKPGS | 1793 |
| $(GKPGS)_5$ | GKPGSGKPGSGKPGSGKPGSGKPGS | 1794 |
| $(GKPGS)_6$ | GKPGSGKPGSGKPGSGKPGSGKPGSGKPGS | 1795 |
| $(GGGES)_1$ or GGGES | GGGES | 1796 |
| "lower half hinge" | KTHTCPPCP | 1797 |
| "full hinge C220S variant" | EPKSSDKTHTCPPCP | 1798 |
| "flex lower half hinge" | GGGGSGGGGSKTHTCPPCP | 1799 |
| "charged lower half hinge1" | GKPGSGKPGSKTHTCPPCP | 1800 |
| "charged lower half hinge2" | GKPGSKTHTCPPCP | 1801 |
| "upper half hinge" | EPKSC | 1802 |
| "flex upper half hinge" | EPKSCGGGGSGGGGS | 1803 |
| "charged upper half hinge1" | EPKSCGKPGSGKPGS | 1804 |
| "charged upper half hinge2" | EPKSCGKPGS | 1805 |

Figure 7A

Heterodimeric Fc Backbone 1

>Heterodimeric Fc Backbone 1 monomer 1 (-) (SEQ ID NO: 1806)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 1 monomer 2 (+) (SEQ ID NO: 1807)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 2

>Heterodimeric Fc Backbone 2 monomer 1 (-) (SEQ ID NO: 1808)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone monomer 2 (+) (SEQ ID NO: 1809)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 3

>Heterodimeric Fc Backbone 3 monomer 1 (-) (SEQ ID NO: 1810)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCEVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 3 monomer 2 (+) (SEQ ID NO: 1811)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 4

>Heterodimeric Fc Backbone 4 monomer 1 (-) (SEQ ID NO: 1812)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTENEVSLTCLVKGFYPSDIAVEWESDG
QPENNYKTTPPVLDSDGSFFLYSKLEVDKSRWEQGDVFSCSVMHEALHNHYTQKSLSLSPGK

>Heterodimeric Fc Backbone 4 monomer 2 (+) (SEQ ID NO: 1813)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSKGSFFLYSKLTVDKSRWQQGNVFSCSVMHEALHNHYTQKSLSLSPGK

Figure 7B

Heterodimeric Fc Backbone 5

>Heterodimeric Fc Backbone 5 monomer 1 (-) (SEQ ID NO: 1814)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSRDELTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 5 monomer 2 (+) (SEQ ID NO: 1815)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 6

>Heterodimeric Fc Backbone 6 monomer 1 (-) (SEQ ID NO: 1816)
APPVAGPSVFLFPPKPKDTLMISRTPEVTCVVVDVKHEDPEVKFNWYVDGVEVHNAKTKPREEEYASTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 6 monomer 2 (+) (SEQ ID NO: 1817)
APPVAGPSVFLFPPKPKDTLMISRTPEVTCVVVDVKHEDPEVKFNWYVDGVEVHNAKTKPREEQYASTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 7

>Heterodimeric Fc Backbone 7 monomer 1 (-) (SEQ ID NO: 1818)
APPVAGPSVFLFPPKPKDTLMISRTPEVTCVVVDVKHEDPEVKFNWYVDGVEVHNAKTKPREEEYSSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

>Heterodimeric Fc Backbone 7 monomer 2 (+) (SEQ ID NO: 1819)
APPVAGPSVFLFPPKPKDTLMISRTPEVTCVVVDVKHEDPEVKFNWYVDGVEVHNAKTKPREEQYSSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Heterodimeric Fc Backbone 8

>Heterodimeric Fc Backbone 8 monomer 1 (-) (SEQ ID NO: 1820)
APEFLGGPSVFLFPPKPKDTLMISRTPEVTCVVVDVSQEDPEVQFNWYVDGVEVHNAKTKPREEEFNSTYRVVSVLT
VLHQDWLNGKEYKCKVSNKGLPSSIEKTISKAKGQPREPQVYTLPPSQEEMTKNQVSLTCDVSGFYPSDIAVEWESD
GQPENNYKTTPPVLDSDGSFFLYSRLTVDKSRWEEGDVFSCSVMHEALHNHYTQKSLSLSLGK

>Heterodimeric Fc Backbone 8 monomer 2 (+) (SEQ ID NO: 1821)
APEFLGGPSVFLFPPKPKDTLMISRTPEVTCVVVDVSQEDPEVQFNWYVDGVEVHNAKTKPREEQFNSTYRVVSVLT
VLHQDWLNGKEYKCKVSNKGLPSSIEKTISKAKGQPREPQVYTLPPSQEQMTKNQVKLTCLVKGFYPSDIAVEWESN
GQPENNYKTTPPVLDSDGSFFLYSRLTVDKSRWQEGNVFSCSVMHEALHNHYTQKSLSLSLGK

Figure 7C

Heterodimeric Fc Backbone 9

>Heterodimeric Fc Backbone 9 monomer 1 (-) (SEQ ID NO: 1822)
APPVAGPSVFLFPPKPKDTLMISRTPEVTCVVVDVSHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 9 monomer 2 (+) (SEQ ID NO: 1823)
APPVAGPSVFLFPPKPKDTLMISRTPEVTCVVVDVSHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 10

>Heterodimeric Fc Backbone 10 monomer 1 (-) (SEQ ID NO: 1824)
APPVAGPSVFLFPPKPKDTLMISRTPEVTCVVVDVKHEDPEVQFNWYVDGVEVHNAKTKPREEEFNSTFRVVSVLTV
VHQDWLNGKEYKCKVSNKGLPAPIEKTISKTKGQPREPQVYTLPPSREEMTKNQVSLTCDVSGFYPSDIAVEWESDG
QPENNYKTTPPMLDSDGSFFLYSKLTVDKSRWEQGDVFSCSVMHEALHNHYTQKSLSLSPGK

>Heterodimeric Fc Backbone 10 monomer 2 (+) (SEQ ID NO: 1825)
APPVAGPSVFLFPPKPKDTLMISRTPEVTCVVVDVKHEDPEVQFNWYVDGVEVHNAKTKPREEQFNSTFRVVSVLTV
VHQDWLNGKEYKCKVSNKGLPAPIEKTISKTKGQPREPQVYTLPPSREQMTKNQVKLTCLVKGFYPSDIAVEWESNG
QPENNYKTTPPMLDSDGSFFLYSKLTVDKSRWQQGNVFSCSVMHEALHNHYTQKSLSLSPGK

Heterodimeric Fc Backbone 11

>Heterodimeric Fc Backbone 11 monomer 1 (-) (SEQ ID NO: 1826)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

>Heterodimeric Fc Backbone 11 monomer 2 (+) (SEQ ID NO: 1827)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHSHYTQKSLSLSPGK

Heterodimeric Fc Backbone 12

>Heterodimeric Fc Backbone 12 monomer 1 (-) (SEQ ID NO: 1828)
APPVAGPSVFLFPPKPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

>Heterodimeric Fc Backbone 12 monomer 2 (+) (SEQ ID NO: 1829)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Figure 7D

Heterodimeric Fc Backbone 13

>Heterodimeric Fc Backbone 13 monomer 1 (-) (SEQ ID NO: 1830)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSRDELTKNQVSLTCDVSGFYPSDIAVEWESDG
QPENNYKTTPPVLDSDGSFFLYSKLTVDKSRWEQGDVFSCSVLHEALHSHYTQKSLSLSPGK

>Heterodimeric Fc Backbone 13 monomer 2 (+) (SEQ ID NO: 1831)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVLHEALHSHYTQKSLSLSPGK

Heterodimeric Fc Backbone 14

>Heterodimeric Fc Backbone 14 monomer 1 (-) (SEQ ID NO: 1832)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHAHYTQKSLSLSPGK

>Heterodimeric Fc Backbone 14 monomer 2 (+) (SEQ ID NO: 1833)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHAHYTQKSLSLSPGK

Heterodimeric Fc Backbone 15

>Heterodimeric Fc Backbone 15 monomer 1 (-) (SEQ ID NO: 1834)
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSRDELTKNQVSLTCDVSGFYPSDIAVEWESDG
QPENNYKTTPPVLDSDGSFFLYSKLTVDKSRWEQGDVFSCSVLHEALHAHYTQKSLSLSPGK

>Heterodimeric Fc Backbone 15 monomer 2 (+) (SEQ ID NO: 1835)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVLHEALHAHYTQKSLSLSPGK

Figure 8

IgG1 CH1(+) + hinge (SEQ ID NO:1836)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCP

IgG1 CH1(-) + hinge (SEQ ID NO:1837)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCP

IgG2 CH1(+) + hinge (SEQ ID NO:1838)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCP

IgG2 CH1(-) + hinge (SEQ ID NO:1839)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCP

IgG4 CH1(+) + hinge (SEQ ID NO:1840)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRVESKYGPPCPSCP

IgG4 CH1(-) + hinge (SEQ ID NO:1841)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPSCP

Figure 9

IgG1 CH1(+) + hinge (SEQ ID NO:1836)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCP

IgG2 CH1(+) + hinge (SEQ ID NO:1838)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTVERKCCVECPPCP

IgG4 CH1(+) + hinge (SEQ ID NO:1840)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRVESKYGPPCPSCP

Figure 10

IgG1 CH1(+) (SEQ ID NO:1842)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKV

IgG1 CH1(-) (SEQ ID NO:1843)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKV

IgG2 CH1(+) (SEQ ID NO:1844)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSNTKVDKTV

IgG2 CH1(-) (SEQ ID NO:1845)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTV

IgG4 CH1(+) (SEQ ID NO:1846)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSNTKVDKRV

IgG4 CH1(-) (SEQ ID NO:1847)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRV

Figure 11

IgG1 hinge (SEQ ID NO:1848)
EPKSCDKTHTCPPCP

IgG2 hinge (SEQ ID NO:1849)
ERKCCVECPPCP

IgG4 hinge (SEQ ID NO:1850)
ESKYGPPCPSCP

Figure 12

Constant Light Domain – Kappa (SEQ ID NO:1851)
RTVAAPSVFIFPPSDEQLKSGTASVVCLLNNFYPREAKVQWKVDNALQSGNSQESVTEQDSKDSTYSLSSTLTLSKADYEKHKVYACEVTHQG
LSSPVTKSFNRGEC

Constant Light Domain – Lambda (SEQ ID NO:1852)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

Figure 13

>XENP16432 Nivolumab_H0L0_IgG1_PVA_/S267K

Heavy Chain (SEQ ID NO:1853)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

Light Chain (SEQ ID NO:1854)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 18

Human TGFßRII sequence (SEQ ID NO: 1855)

>sp|P37173
MGRGLLRGLWPLHIVLWTRIASTIPPHVQKSVNNDMIVTDNNGAVKFPQLCKFCDVRFSTCDNQKSCMSNCSITSIC
EKPQEVCVAVWRKNDENITLETVCHDPKLPYHDFILEDAASPKCIMKEKKKPGETFFMCSCSSDECNDNIIFSEEYN
TSNPDLLLVIFQVTGISLLPPLGVAISVIIIFYCYRVNRQQKLSSTWETGKTRKLMEFSEHCAIILEDDRSDISSTC
ANNINHNTELLPIELDTLVGKGRFAEVYKAKLKQNTSEQFETVAVKIFPYEEYASWKTEKDIFSDINLKHENILQFL
TAEERKTELGKQYWLITAFHAKGNLQEYLTRHVISWEDLRKLGSSLARGIAHLHSDHTPCGRPKMPIVHRDLKSSNI
LVKNDLTCCLCDFGLSLRLDPTLSVDDLANSGQVGTARYMAPEVLESRMNLENVESFKQTDVYSMALVLWEMTSRCN
AVGEVKDYEPPFGSKVREHPCVESMKDNVLRDRGRPEIPSFWLNHQGIQMVCETLTECWDHDPEARLTAQCVAERFS
ELEHLDRLSGRSCSEEKIPEDGSLNTTK

Human TGFßRII sequence, extracellular domain (SEQ ID NO: 1856)

>sp|P37173|23-166
TIPPHVQKSVNNDMIVTDNNGAVKFPQLCKFCDVRFSTCDNQKSCMSNCSITSICEKPQEVCVAVWRKNDENITLET
VCHDPKLPYHDFILEDAASPKCIMKEKKKPGETFFMCSCSSDECNDNIIFSEEYNTSNPDLLLVIFQ

Macaca fascicularis TGFßRII sequence (SEQ ID NO: 1857)

>tr|A0A2K5WD91
MGRGLLRGLWPLHIVLWTRIASTIPPHVQKSVNNDMMVTDNNGAVKFPQLCKFCDVRFSTCDNQKSCLSNCSITSIC
EKPQEVCVAVWRKNDENITLETVCHDPKLPYHDFILEDAASPKCIMKEKKKPGETFFMCSCSSDECNDNIIFSEEYN
TSNPDLLLVIFQVTGISLLPPLGVAISVIIIFYCYRVNRQQKLSSSWEAGKPRKLMDFSEHCAIILEDDRSDISSTC
ANNINHNTELLPIELDTLVGKGRFAEVYKAKLKQNTSEQFETVAVKIFPYEEYASWKTEKDIFSDINLKHENILQFL
TAEERKTELGKQYWLITAFHAKGNLQEYLTRHVISWEDLRKLGSSLARGIAHLHSDHTPCGRPKMPIVHRDLKSSNI
LVKNDLTCCLCDFGLSLRLDPTLSVDDLANSGQVGTARYMAPEVLESRMNLENVESFKQTDVYSMALVLWEMTSRCN
AVGEVKDYEPPFGSKVREHPCVESMKDNVLRDRGRPEIPSFWLNHQGIQMVCETLTECWDHDPEARLTAQCVAERFS
ELEHLDRLSGRSCSEEKIPEDGSLNTTK

Macaca fascicularis TGFßRII sequence, extracellular domain (predicted) (SEQ ID NO: 1858)

>tr|A0A2K5WD91|23-166
TIPPHVQKSVNNDMMVTDNNGAVKFPQLCKFCDVRFSTCDNQKSCLSNCSITSICEKPQEVCVAVWRKNDENITLET
VCHDPKLPYHDFILEDAASPKCIMKEKKKPGETFFMCSCSSDECNDNIIFSEEYNTSNPDLLLVIFQ

Figure 19A

TBRII-A_H1 Variable Heavy

| | sequence | SEQ ID NO: |
|---|---|---|
| Variable heavy (vh) domain | QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS | 1859 |
| vhCDR1 | NSYFSWG | 1860 |
| vhCDR2 | SFYYGEKTYYNPSLKS | 1861 |
| vhCDR3 | GPTMIRGVIDS | 1862 |

TBRII-A_H1.1 Variable Heavy

| | sequence | SEQ ID NO: |
|---|---|---|
| Variable heavy (vh) domain | QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSS | 1863 |
| vhCDR1 | NSYFSWG | 1864 |
| vhCDR2 | SFYYGEKTYYNPSLKS | 1865 |
| vhCDR3 | GPTVIRGVIDS | 1866 |

TBRII-A_L1 Variable Light

| | Sequence | SEQ ID NO: |
|---|---|---|
| Variable light (vl) domain | EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK | 1867 |
| vlCDR1 | RASQSVRSYLA | 1868 |
| vlCDR2 | DASNRAT | 1869 |
| vlCDR3 | QQRSNWPPT | 1870 |

TBRII-B_H1 Variable Heavy

| | sequence | SEQ ID NO: |
|---|---|---|
| Variable heavy (vh) domain | EVQLLESGGGLVQPGGSLRLSCAASGFTFGTEQMWWVRQAPGKGLEFVSRIDSPGGRTYYANSVKGRFTISRDNSKNTLYLQMNSLRAEDTAVYYCAKRRPTGVSGTFYDYWGQGTLVTVSS | 1871 |
| vhCDR1 | TEQMW | 1872 |
| vhCDR2 | RIDSPGGRTYYANSVKG | 1873 |
| vhCDR3 | RRPTGVSGTFYDY | 1874 |

Figure 19B

TBRII-C_H1 Variable Heavy

| | sequence | SEQ ID NO: |
|---|---|---|
| **Variable heavy (vh) domain** | EVQLVESGGGLVKPGGSLRLSCAASGFTFSSFSMNWVRQAPGKGLEWVSSISSSSSYIYYTDSVKGRFTISRDNAKNSLYLQMNSLRAEDTAVYYCARGYWGFDYWGQGTLVTVSS | 1875 |
| **vhCDR1** | SFSMN | 1876 |
| **vhCDR2** | SISSSSSYIYYTDSVKG | 1877 |
| **vhCDR3** | GYWGFDY | 1878 |

TBRII-C_L1 Variable Light

| | Sequence | SEQ ID NO: |
|---|---|---|
| **Variable light (vl) domain** | DIQMTQSPSSLSASVGDRVTITCRASQGIRNDLGWYQQKPGKAPKRLIYAASSLQSGVPSRFSGSASGTEFTLTISSLQPEDFATYYCLQHNSNPLTFGGGTKVEIK | 1879 |
| **vlCDR1** | RASQGIRNDLG | 1880 |
| **vlCDR2** | AASSLQS | 1881 |
| **vlCDR3** | LQHNSNPLT | 1882 |

Figure 20

>XENP28296 TBRII-A[TGFßRII]_H1L1_IgG1_PVA_/S267K

Chain 1 - TBRII-A[TGFßRII]_H1_IgG1_PVA_/S267K Heavy Chain (SEQ ID NO: 1883)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Chain 2 - TBRII-A[TGFßRII]_L1 Light Chain (SEQ ID NO: 1884)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP28297 TBRII-A[TGFßRII]_H1.1_L1_IgG1_PVA_/S267K

Chain 1 - TBRII-A[TGFßRII]_H1.1_IgG1_PVA_/S267K Heavy Chain (SEQ ID NO: 1885)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAVEW
ESNGQPENNYKTTPPVLDSDGSFFLYSKLTVDKSRWQQGNVFSCSVMHEALHNHYTQKSLSLSPGK

Chain 2 - TBRII-A[TGFßRII]_L1 Light Chain (SEQ ID NO: 1886)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP33038 TBRII-C[TGFßRII]_H1L1_IgG1_PVA_/S267K

Chain 1 - TBRII-C[TGFßRII]_H1_IgG1_PVA_/S267K Heavy Chain (SEQ ID NO: 1887)

EVQLVESGGGLVKPGGSLRLSCAASGFTFSSFSMNWVRQAPGKGLEWVSSISSSSSYIYYTDSVKGRFTISRDNAKN
SLYLQMNSLRAEDTAVYYCARGYWGFDYWGQGTLVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPA
PPVAGPSVFLFPPKPKDTLMISRTPEVTCVVVDVKHEDPEVKFNWYVDGVEVHNAKTKPREEQYNSTYRVVSVLTVL
HQDWLNGKEYKCKVSNKALPAPIEKTISKAKGQPREPQVYTLPPSREEMTKNQVSLTCLVKGFYPSDIAVEWESNGQ
PENNYKTTPPVLDSDGSFFLYSKLTVDKSRWQQGNVFSCSVMHEALHNHYTQKSLSLSPGK

Chain 2 - TBRII-C[TGFßRII]_L1 Light Chain (SEQ ID NO: 1888)

DIQMTQSPSSLSASVGDRVTITCRASQGIRNDLGWYQQKPGKAPKRLIYAASSLQSGVPSRFSGSASGTEFTLTISS
LQPEDFATYYCLQHNSNPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP33040 TBRII-B[TGFßRII]_H1_Fc(216)_IgG1_C220S/PVA_/S267K (SEQ ID NO: 1889)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREEMTKNQVSLTCLVKGFYPSDIAVEWESNGQPENNYKTTPPVLDSD
GSFFLYSKLTVDKSRWQQGNVFSCSVMHEALHNHYTQKSLSLSPGK

Figure 22

Human PD-1 sequence (SEQ ID NO: 1890)

>sp|Q15116

MQIPQAPWPVVWAVLQLGWRPGWFLDSPDRPWNPPTFSPALLVVTEGDNATFTCSFSNTSESFVLNWYRMSPSNQTD
KLAAFPEDRSQPGQDCRFRVTQLPNGRDFHMSVVRARRNDSGTYLCGAISLAPKAQIKESLRAELRVTERRAEVPTA
HPSPSPRPAGQFQTLVVGVVGGLLGSLVLLVWVLAVICSRAARGTIGARRTGQPLKEDPSAVPVFSVDYGELDFQWR
EKTPEPPVPCVPEQTEYATIVFPSGMGTSSPARRGSADGPRSAQPLRPEDGHCSWPL

Human PD-1 sequence, extracellular domain (SEQ ID NO: 1891)

>sp|Q15116|21-170

PGWFLDSPDRPWNPPTFSPALLVVTEGDNATFTCSFSNTSESFVLNWYRMSPSNQTDKLAAFPEDRSQPGQDCRFRV
TQLPNGRDFHMSVVRARRNDSGTYLCGAISLAPKAQIKESLRAELRVTERRAEVPTAHPSPSPRPAGQFQTLV

Macaca fascicularis PD-1 sequence (SEQ ID NO: 1892)

>tr|B0LAJ3

MQIPQAPWPVVWAVLQLGWRPGWFLESPDRPWNAPTFSPALLLVTEGDNATFTCSFSNASESFVLNWYRMSPSNQTD
KLAAFPEDRSQPGQDCRFRVTRLPNGRDFHMSVVRARRNDSGTYLCGAISLAPKAQIKESLRAELRVTERRAEVPTA
HPSPSPRPAGQFQALVVGVVGGLLGSLVLLVWVLAVICSRAAQGTIEARRTGQPLKEDPSAVPVFSVDYGELDFQWR
EKTPEPPAPCVPEQTEYATIVFPSGLGTSSPARRGSADGPRSPRPLRPEDGHCSWPL

Macaca fascicularis PD-1 sequence, extracellular domain (predicted) (SEQ ID NO: 1893)

>tr|B0LAJ3|21-170

PGWFLESPDRPWNAPTFSPALLLVTEGDNATFTCSFSNASESFVLNWYRMSPSNQTDKLAAFPEDRSQPGQDCRFRV
TRLPNGRDFHMSVVRARRNDSGTYLCGAISLAPKAQIKESLRAELRVTERRAEVPTAHPSPSPRPAGQFQALV

Figure 23

| | nivolumab-based αPD-1 | in-house produced pembrolizumab | chimeric mAb A | chimeric mAb B | chimeric mAb C | PDL1-Fc |
|---|---|---|---|---|---|---|
| **nivolumab-based αPD-1** | 0.0468 | 0.0143 | 0.9692 | 0.9248 | 0.9299 | 0.1582 |
| **in-house produced pembrolizumab** | 0.0816 | 0.0301 | 0.8851 | 0.8414 | 0.8542 | 0.1585 |
| **chimeric mAb A** | 1.0095 | 1.0145 | 0.0141 | 0.0106 | 0.0157 | 0.5737 |
| **chimeric mAb B** | 0.8851 | 0.9078 | 0.0368 | 0.0237 | 0.0222 | 0.3376 |
| **chimeric mAb C** | 0.8889 | 0.9079 | 0.0372 | 0.0161 | 0.0372 | 0.2058 |
| **HBS-EP** | 1 | 1 | 1 | 1 | 1 | 1 |
| **PDL1-Fc** | 0.5418 | 0.5045 | 0.9274 | 0.9341 | 0.9142 | 0.3162 |

Figure 24A

>XENP33041 TBRII-C[TGFßRII]_H1L1_Fab-mAb C[PD1]_H1_L1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_L1.1_scFv(GKPGS)4_Fc(216)_IgG1_C220S/PVA_/S267K/S364K/E357Q (SEQ ID NO: 1894)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/GKPGSGKPGSGKPGSGKPGS/DIVMTQSPDSLAV
SLGERATINCKSSQSLLHSGNQKNYLTWYQQKPGQPPKLLIYWASTRESGVPDRFTGSGSGTDFTLTISSLQAEDVA
VYYCQNDYSYPFTFGSGTKLEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Chain 2 - TBRII-C[TGFßRII]_H1_IgG1_pI(-)_Isosteric_A_PVA_/S267K/L368D/K370S (SEQ ID NO: 1895)

EVQLVESGGGLVKPGGSLRLSCAASGFTFSSFSMNWVRQAPGKGLEWVSSISSSSSYIYYTDSVKGRFTISRDNAKN
SLYLQMNSLRAEDTAVYYCARGYWGFDYWGQGTLVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK

Chain 3 - TBRII-C[TGFßRII]_L1 Light Chain (SEQ ID NO: 1896)

DIQMTQSPSSLSASVGDRVTITCRASQGIRNDLGWYQQKPGKAPKRLIYAASSLQSGVPSRFSGSASGTEFTLTISS
LQPEDFATYYCLQHNSNPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP33044 TBRII-A[TGFßRII]_H1L1_Fab-mAb C[PD1]_H1_L1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - TBRII-A[TGFßRII]_H1_IgG1_pI(-)_Isosteric_A_PVA_/S267K/L368D/K370S (SEQ ID NO: 1897)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - mAb C[PD1]_H1_L1.1_scFv(GKPGS)4_Fc(216)_IgG1_C220S/PVA_/S267K/S364K/E357Q (SEQ ID NO: 1898)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/GKPGSGKPGSGKPGSGKPGS/DIVMTQSPDSLAV
SLGERATINCKSSQSLLHSGNQKNYLTWYQQKPGQPPKLLIYWASTRESGVPDRFTGSGSGTDFTLTISSLQAEDVA
VYYCQNDYSYPFTFGSGTKLEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Chain 3 - TBRII-A[TGFßRII]_L1 Light Chain (SEQ ID NO: 1899)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 24B

>XENP33045 TBRII-A[TGFßRII]_H1.1_L1_Fab-mAb C[PD1]_H1_L1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - TBRII-A[TGFßRII]_H1.1_IgG1_pI(-)_Isosteric_A_PVA_/S267K/L368D/K370S (SEQ ID NO: 1900)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - mAb C[PD1]_H1_L1.1_scFv(GKPGS)4_Fc(216)_IgG1_C220S/PVA_/S267K/S364K/E357Q (SEQ ID NO: 1901)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/GKPGSGKPGSGKPGSGKPGS/DIVMTQSPDSLAV
SLGERATINCKSSQSLLHSGNQKNYLTWYQQKPGQPPKLLIYWASTRESGVPDRFTGSGSGTDFTLTISSLQAEDVA
VYYCQNDYSYPFTFGSGTKLEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Chain 3 - TBRII-A[TGFßRII]_L1 Light Chain (SEQ ID NO: 1902)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP34287 mAb C[PD1]_H1_L1.1_Fab-TBRII-A[TGFßRII]_H1L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1903)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1L1_scFv(GKPGS)4_Fc(216)_IgG1_C220S/PVA_/S267K/S364K/E357Q (SEQ ID NO: 1904)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1905)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24C

>XENP34288 mAb C[PD1]_H1_L1.1_Fab-TBRII-A[TGFßRII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1906)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 1907)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1908)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP34289 mAb C[PD1]_H1_L1.1_Fab-TBRII-C[TGFßRII]_H1L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1909)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-C[TGFßRII]_H1L1_scFv(GKPGS)4_Fc(216)_IgG1_C220S/PVA_/S267K/S364K/E357Q (SEQ ID NO: 1910)

EVQLVESGGGLVKPGGSLRLSCAASGFTFSSFSMNWVRQAPGKGLEWVSSISSSSSYIYYTDSVKGRFTISRDNAKN
SLYLQMNSLRAEDTAVYYCARGYWGFDYWGQGTLVTVSS/GKPGSGKPGSGKPGSGKPGS/DIQMTQSPSSLSASVG
DRVTITCRASQGIRNDLGWYQQKPGKAPKRLIYAASSLQSGVPSRFSGSASGTEFTLTISSLQPEDFATYYCLQHNS
NPLTFGGGTKVEIK/EPKSSDKTHTCPPCPAPPVAGPSVFLFPPKPKDTLMISRTPEVTCVVVDVKHEDPEVKFNWY
VDGVEVHNAKTKPREEQYNSTYRVVSVLTVLHQDWLNGKEYKCKVSNKALPAPIEKTISKAKGQPREPQVYTLPPSR
EQMTKNQVKLTCLVKGFYPSDIAVEWESNGQPENNYKTTPPVLDSDGSFFLYSKLTVDKSRWQQGNVFSCSVMHEAL
HNHYTQKSLSLSPGK

Chain 3 - mAb C[PD1]_L1.1 Light Chain (SEQ ID NO: 1911)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24D

>XENP35103 mAb C[PD1]_H1_L1.1_Fab-TBRII-A[TGFßRII]_H1.21_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1912)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.21_L1_scFv(GKPGS)4_Fc(216)_IgG1_C220S/PVA_/S267K/S364K/E357Q (SEQ ID NO: 1913)
QLQVQESGPGLVKPSETLSLTCTVSGGSISNSAFSWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1914)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC >XENP35104 mAb C[PD1]_H1_L1.1_Fab-TBRII-A[TGFßRII]_H1.29_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1915)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.29_L1_scFv(GKPGS)4_Fc(216)_IgG1_C220S/PVA_/S267K/S364K/E357Q (SEQ ID NO: 1916)
QLQVQESGPGLVKPSETLSLTCTVSGGSISNSYFTWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1917)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24E

>XENP35105 mAb C[PD1]_H1_L1.1_Fab-TBRII-A[TGFßRII]_H1.30_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1918)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 1919)
QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1920)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC >XENP35106 mAb C[PD1]_H1_L1.1_Fab-TBRII-A[TGFßRII]_H1.33_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1921)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.33_L1_scFv(GKPGS)4_Fc(216)_IgG1_C220S/PVA_/S267K/S364K/E357Q (SEQ ID NO: 1922)
QLQVQESGPGLVKPSETLSLTCTVSGGSISNSYFSWAWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1923)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24F

>XENP35107 mAb C[PD1]_H1_L1.1_Fab-TBRII-A[TGFßRII]_H1.36_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1924)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.36_L1_scFv(GKPGS)4_Fc(216)_IgG1_C220S/PVA_/S267K/S364K/E357Q (SEQ ID NO: 1925)
QLQVQESGPGLVKPSETLSLTCTVSGGSISNSYFSWSWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1926)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP35108 mAb C[PD1]_H1_L1.1_Fab-TBRII-A[TGFßRII]_H1.37_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1927)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.37_L1_scFv(GKPGS)4_Fc(216)_IgG1_C220S/PVA_/S267K/S364K/E357Q (SEQ ID NO: 1928)
QLQVQESGPGLVKPSETLSLTCTVSGGSISNSYFSWGWVRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1929)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24G

>XENP35109 mAb C[PD1]_H1_L1.1_Fab-TBRII-A[TGFßRII]_H1.51_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1930)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 1931)
QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1932)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP35110 mAb C[PD1]_H1_L1.1_Fab-TBRII-A[TGFßRII]_H1.56_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1933)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.56_L1_scFv(GKPGS)4_Fc(216)_IgG1_C220S/PVA_/S267K/S364K/E357Q (SEQ ID NO: 1934)
QLQVQESGPGLVKPSETLSLTCTVSGGSISNSYFSWGWIRQPPGKGLEWIGSFYYGGKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1935)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24H

>XENP35111 mAb C[PD1]_H1_L1.1_Fab-TBRII-A[TGFßRII]_H1.48_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1936)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.48_L1_scFv(GKPGS)4_Fc(216)_IgG1_C220S/PVA_/S267K/S364K/E357Q (SEQ ID NO: 1937)
QLQVQESGPGLVKPSETLSLTCTVSGGSISNSYFSWGWIRQPPGKGLEWIGSFDYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1938)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP35112 mAb C[PD1]_H1_L1.1_Fab-TBRII-A[TGFßRII]_H1.50_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1939)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.50_L1_scFv(GKPGS)4_Fc(216)_IgG1_C220S/PVA_/S267K/S364K/E357Q (SEQ ID NO: 1940)
QLQVQESGPGLVKPSETLSLTCTVSGGSISNSYFSWGWIRQPPGKGLEWIGSFKYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - mAb C[PD1]_L1.1 Light Chain (SEQ ID NO: 1941)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24I

XENP35186 mAb C[PD1]_H1_L1.1_Fab-TBRII-A[TGF RII]_L1_H1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1942)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_L1_H1.1_scFv(GKPGS)4_Fc(216)_IgG1_C220S/PVA_/S267K/S364K/E357Q (SEQ ID NO: 1943)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIKGKPGSGKPGSGKPGSGKPGSQLQVQESGPGLVKPSETLSLTCTVSGG
SISNSYFSWGWIRQPPGKGLEWIGSFYYGEKTYYNPSLKSRATISIDTSKSQFSLKLSSVTAADTAVYYCPRGPTVI
RGVIDSWGQGTLVTVSS/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1944)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP35545 mAb C[PD1]_H1_L1.1_Fab-TBRII-A[TGF RII]_H1.15_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1945)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.15_L1_scFv(GKPGS)4_Fc(216)_IgG1_C220S/PVA_/S267K/S364K/E357Q (SEQ ID NO: 1946)

QLQVQESGPGLVKPSETLSLTCTVSGGSISTSYFSWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1947)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24J

XENP35546 mAb C[PD1]_H1_L1.1_Fab-TBRII-A[TGF RII]_H1.18_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1948)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.18_L1_scFv(GKPGS)4_Fc(216)_IgG1_C220S/PVA_/S267K/S364K/E357Q (SEQ ID NO: 1949)

QLQVQESGPGLVKPSETLSLTCTVSGGSISNAYFSWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1950)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP35547 mAb C[PD1]_H1_L1.1_Fab-TBRII-A[TGF RII]_H1.34_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1951)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.34_L1_scFv(GKPGS)4_Fc(216)_IgG1_C220S/PVA_/S267K/S364K/E357Q (SEQ ID NO: 1952)

QLQVQESGPGLVKPSETLSLTCTVSGGSISNSYFSWHWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1953)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24K

XENP35548 mAb C[PD1]_H1_L1.1_Fab-TBRII-A[TGF RII]_H1.78_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1954)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.78_L1_scFv(GKPGS)4_Fc(216)_IgG1_C220S/PVA_/S267K/S364K/E357Q (SEQ ID NO: 1955)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1956)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP35549 mAb C[PD1]_H1_L1.1_Fab-TBRII-A[TGF RII]_H1.86_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1957)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.86_L1_scFv(GKPGS)4_Fc(216)_IgG1_C220S/PVA_/S267K/S364K/E357Q (SEQ ID NO: 1958)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1959)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24L

XENP35550 mAb C[PD1]_H1_L1.1_Fab-TBRII-A[TGF RII]_H1.103_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1960)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.103_L1_scFv(GKPGS)4_Fc(216)_IgG1_C220S/PVA_/S267K/S364K/E357Q (SEQ ID NO: 1961)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDLWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1962)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP35551 mAb C[PD1]_H1_L1.1_Fab-TBRII-A[TGF RII]_H1_L1.47_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1963)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1_L1.47_scFv(GKPGS)4_Fc(216)_IgG1_C220S/PVA_/S267K/S364K/E357Q (SEQ ID NO: 1964)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSQWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1965)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24M

XENP35552 mAb C[PD1]_H1_L1.1_Fab-TBRII-A[TGF RII]_H1_L1.53_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1966)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1_L1.53_scFv(GKPGS)4_Fc(216)_IgG1_C220S/PVA_/S267K/S364K/E357Q (SEQ ID NO: 1967)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1968)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36124 mAb C[PD1]_H1.19_L1.140_Fab-TBRII-A[TGF RII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1.19_IgG1_pI(-)_Isosteric_A_PVA_/S267K/L368D/K370S (SEQ ID NO: 1969)

EVQLVESGGGLVQPGGSLRLSCAASGFTFSSLGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.1_L1_scFv(GKPGS)4_Fc(216)_IgG1_C220S/PVA_/S267K/S364K/E357Q (SEQ ID NO: 1970)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.140 Light Chain (SEQ ID NO: 1971)

DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24N

XENP36125 mAb C[PD1]_H1.169_L1.140_Fab-TBRII-A[TGF RII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1.169_IgG1_pI(-)_Isosteric_A_PVA_/S267K/L368D/K370S (SEQ ID NO: 1972)

EVQLVESGGGLVQPGGSLRLSCAASGFTFSSLGMHWVRQAPGKGLEWVSYISGGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.1_L1_scFv(GKPGS)4_Fc(216)_IgG1_C220S/PVA_/S267K/S364K/E357Q (SEQ ID NO: 1973)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.140 Light Chain (SEQ ID NO: 1974)

DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36126 mAb C[PD1]_H1.175_L1.140_Fab-TBRII-A[TGF RII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1.175_IgG1_pI(-)_Isosteric_A_PVA_/S267K/L368D/K370S (SEQ ID NO: 1975)

EVQLVESGGGLVQPGGSLRLSCAASGFTFSSLGMHWVRQAPGKGLEWVSYISGGSSIIYYADSVKGRFTISRDNAKN
SLYLQMNSLRAEDTAVYYCARGGWLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.1_L1_scFv(GKPGS)4_Fc(216)_IgG1_C220S/PVA_/S267K/S364K/E357Q (SEQ ID NO: 1976)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.140 Light Chain (SEQ ID NO: 1977)

DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24O

XENP36127 mAb C[PD1]_H1.176_L1.140_Fab-TBRII-A[TGF RII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1.176_IgG1_pI(-)_Isosteric_A_PVA_/S267K/L368D/K370S (SEQ ID NO: 1978)

EVQLVESGGGLVQPGGSLRLSCAASGFTFSSLGMHWVRQAPGKGLEWVSYISSGSSIIYYADSVKGRFTISRDNAKN
SLYLQMNSLRAEDTAVYYCARGGRLVFSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.1_L1_scFv(GKPGS)4_Fc(216)_IgG1_C220S/PVA_/S267K/S364K/E357Q (SEQ ID NO: 1979)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.140 Light Chain (SEQ ID NO: 1980)

DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36164 mAb C[PD1]_H1_L1.1_Fab-TBRII-A[TGF RII]_H1.181_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1981)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.181_L1_scFv(GKPGS)4_Fc(216)_IgG1_C220S/PVA_/S267K/S364K/E357Q (SEQ ID NO: 1982)

QLQVQESGPGLVKPSETLSLTCTVSGGSISNSYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1983)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24P

XENP36166 mAb C[PD1]_H1_L1.1_Fab-TBRII-A[TGF RII]_H1.183_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1984)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.183_L1_scFv(GKPGS)4_Fc(216)_IgG1_C220S/PVA_/S267K/S364K/E357Q (SEQ ID NO: 1985)

QLQVQESGPGLVKPSETLSLTCTVSGGSISNSYFSWGWIRQPPGKGLEWIGSFYYGGKTYYNPSLKSRATISIDTSK
NQFSLKLSSVTAADTAVYYCARGPTMIRGVFDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1986)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36167 mAb C[PD1]_H1_L1.1_Fab-TBRII-A[TGF RII]_H1.184_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1987)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.184_L1_scFv(GKPGS)4_Fc(216)_IgG1_C220S/PVA_/S267K/S364K/E357Q (SEQ ID NO: 1988)

QLQVQESGPGLVKPSETLSLTCTVSGGSISESYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1989)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24Q

XENP36168 mAb C[PD1]_H1_L1.1_Fab-TBRII-A[TGF RII]_H1.185_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1990)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.185_L1_scFv(GKPGS)4_Fc(216)_IgG1_C220S/PVA_/S267K/S364K/E357Q (SEQ ID NO: 1991)

QLQVQESGPGLVKPSETLSLTCTVSGGSISESYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1992)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36169 mAb C[PD1]_H1_L1.1_Fab-TBRII-A[TGF RII]_H1.186_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1993)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.186_L1_scFv(GKPGS)4_Fc(216)_IgG1_C220S/PVA_/S267K/S364K/E357Q (SEQ ID NO: 1994)

QLQVQESGPGLVKPSETLSLTCTVSGGSISESYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1995)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24R

XENP36170_mAb_C[PD1]_H1_L1.1_Fab-TBRII-A[TGF RII]_H1.187_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1996)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.187_L1_scFv(GKPGS)4_Fc(216)_IgG1_C220S/PVA_/S267K/S364K/E357Q (SEQ ID NO: 1997)

QLQVQESGPGLVKPSETLSLTCTVSGGSISESYFSWGWIRQPPGKGLEWIGSFYYGGKTYYNPSLKSRATISIDTSK
NQFSLKLSSVTAADTAVYYCARGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 1998)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36171_mAb_C[PD1]_H1_L1.1_Fab-TBRII-A[TGF RII]_H1.188_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 1999)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.188_L1_scFv(GKPGS)4_Fc(216)_IgG1_C220S/PVA_/S267K/S364K/E357Q (SEQ ID NO: 2000)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2001)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24S

XENP36172 mAb C[PD1]_H1_L1.1_Fab-TBRII-A[TGF RII]_H1.189_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2002)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.189_L1_scFv(GKPGS)4_Fc(216)_IgG1_C220S/PVA_/S267K/S364K/E357Q (SEQ ID NO: 2003)
QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2004)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36173 mAb C[PD1]_H1_L1.1_Fab-TBRII-A[TGF RII]_H1.190_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2005)
EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.190_L1_scFv(GKPGS)4_Fc(216)_IgG1_C220S/PVA_/S267K/S364K/E357Q (SEQ ID NO: 2006)
QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2007)
DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24T

XENP36174 mAb C[PD1]_H1_L1.1_Fab-TBRII-A[TGF RII]_H1.191_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2008)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.191_L1_scFv(GKPGS)4_Fc(216)_IgG1_C220S/PVA_/S267K/S364K/E357Q (SEQ ID NO: 2009)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2010)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36175 mAb C[PD1]_H1_L1.1_Fab-TBRII-A[TGF RII]_H1.192_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2011)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.192_L1_scFv(GKPGS)4_Fc(216)_IgG1_C220S/PVA_/S267K/S364K/E357Q (SEQ ID NO: 2012)

QLQVQESGPGLVKPSETLSLTCTVSGGSISTSYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2013)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24U

XENP36176 mAb C[PD1]_H1_L1.1_Fab-TBRII-A[TGF RII]_H1.193_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2014)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.193_L1_scFv(GKPGS)4_Fc(216)_IgG1_C220S/PVA_/S267K/S364K/E357Q (SEQ ID NO: 2015)

QLQVQESGPGLVKPSETLSLTCTVSGGSISTSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2016)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36177 mAb C[PD1]_H1_L1.1_Fab-TBRII-A[TGF RII]_H1.194_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2017)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.194_L1_scFv(GKPGS)4_Fc(216)_IgG1_C220S/PVA_/S267K/S364K/E357Q (SEQ ID NO: 2018)

QLQVQESGPGLVKPSETLSLTCTVSGGSISTSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2019)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24V

XENP36178 mAb C[PD1]_H1_L1.1_Fab-TBRII-A[TGF RII]_H1.195_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2020)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.195_L1_scFv(GKPGS)4_Fc(216)_IgG1_C220S/PVA_/S267K/S364K/E357Q (SEQ ID NO: 2021)

QLQVQESGPGLVKPSETLSLTCTVSGGSISTSYFSWGWIRQPPGKGLEWIGSFYYGGKTYYNPSLKSRATISIDTSK
NQFSLKLSSVTAADTAVYYCARGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2022)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36179 mAb C[PD1]_H1_L1.1_Fab-TBRII-A[TGF RII]_H1.196_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2023)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.196_L1_scFv(GKPGS)4_Fc(216)_IgG1_C220S/PVA_/S267K/S364K/E357Q (SEQ ID NO: 2024)

QLQVQESGPGLVKPSETLSLTCTVSGGSISQSYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2025)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24W

XENP36180 mAb C[PD1]_H1_L1.1_Fab-TBRII-A[TGF RII]_H1.197_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2026)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.197_L1_scFv(GKPGS)4_Fc(216)_IgG1_C220S/PVA_/S267K/S364K/E357Q (SEQ ID NO: 2027)

QLQVQESGPGLVKPSETLSLTCTVSGGSISQSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2028)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36181 mAb C[PD1]_H1_L1.1_Fab-TBRII-A[TGF RII]_H1.198_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2029)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.198_L1_scFv(GKPGS)4_Fc(216)_IgG1_C220S/PVA_/S267K/S364K/E357Q (SEQ ID NO: 2030)

QLQVQESGPGLVKPSETLSLTCTVSGGSISQSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2031)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24X

XENP36182 mAb C[PD1]_H1_L1.1_Fab-TBRII-A[TGF RII]_H1.199_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2032)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.199_L1_scFv(GKPGS)4_Fc(216)_IgG1_C220S/PVA_/S267K/S364K/E357Q (SEQ ID NO: 2033)

QLQVQESGPGLVKPSETLSLTCTVSGGSISQSYFSWGWIRQPPGKGLEWIGSFYYGGKTYYNPSLKSRATISIDTSK
NQFSLKLSSVTAADTAVYYCARGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2034)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36183 mAb C[PD1]_H1_L1.1_Fab-TBRII-A[TGF RII]_H1.200_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2035)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.200_L1_scFv(GKPGS)4_Fc(216)_IgG1_C220S/PVA_/S267K/S364K/E357Q (SEQ ID NO: 2036)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2037)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24Y

XENP36184 mAb C[PD1]_H1_L1.1_Fab-TBRII-A[TGF RII]_H1.201_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2038)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.201_L1_scFv(GKPGS)4_Fc(216)_IgG1_C220S/PVA_/S267K/S364K/E357Q (SEQ ID NO: 2039)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2040)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP36185 mAb C[PD1]_H1_L1.1_Fab-TBRII-A[TGF RII]_H1.202_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2041)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.202_L1_scFv(GKPGS)4_Fc(216)_IgG1_C220S/PVA_/S267K/S364K/E357Q (SEQ ID NO: 2042)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2043)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24Z

XENP36186 mAb C[PD1]_H1_L1.1_Fab-TBRII-A[TGF RII]_H1.203_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2044)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGF RII]_H1.203_L1_scFv(GKPGS)4_Fc(216)_IgG1_C220S/PVA_/S267K/S364K/E357Q (SEQ ID NO: 2045)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - mAb C[PD1]_L1.1 Light Chain (SEQ ID NO: 2046)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

XENP37307 mAb C[PD1]_H1_L1.1_Fab-TBRII-A[TGF RII]_H1.201_L1_scFv(GKPGS)4-IgG1_pI(-)_Isosteric_A_PVA_/S267K/L368D/K370S/M428L/N434S-Fc(216)_IgG1_C220S/PVA_/S267K/S364K/E357Q/M428L/N434S

Chain 1 - mAb C[PD1]_H1_IgG1_pI(-)_Isosteric_A_PVA_/S267K/L368D/K370S/M428L/N434S (SEQ ID NO: 2047)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - TBRII-A[TGF RII]_H1.201_L1_scFv(GKPGS)4_Fc(216)_IgG1_C220S/PVA_/S267K/S364K/E357Q/M428L/N434S (SEQ ID NO: 2048)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVLH
EALHSHYTQKSLSLSPGK

Chain 3 - mAb C[PD1]_L1.1 Light Chain (SEQ ID NO: 2049)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 24AA

XENP37310 mAb C[PD1]_H1.176_L1.140_Fab-TBRII-A[TGF RII]_H1.201_L1_scFv(GKPGS)4-IgG1_pI(-)_Isosteric_A_PVA_/S267K/L368D/K370S/M428L/N434S-Fc(216)_IgG1_C220S/PVA_/S267K/S364K/E357Q/M428L/N434S

Chain 1 - mAb C[PD1]_H1.176_IgG1_pI(-)_Isosteric_A_PVA_/S267K/L368D/K370S/M428L/N434S (SEQ ID NO: 2050)

EVQLVESGGGLVQPGGSLRLSCAASGFTFSSLGMHWVRQAPGKGLEWVSYISSGSSIIYYADSVKGRFTISRDNAKN
SLYLQMNSLRAEDTAVYYCARGGRLVFSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVLHEALHSHYTQKSLSLSPGK

Chain 2 - TBRII-A[TGF RII]_H1.201_L1_scFv(GKPGS)4_Fc(216)_IgG1_C220S/PVA_/S267K/S364K/E357Q/M428L/N434S (SEQ ID NO: 2051)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVLH
EALHSHYTQKSLSLSPGK

Chain 3 - mAb C[PD1]_L1.140 Light Chain (SEQ ID NO: 2052)

DIVMTQSPDSLAVSLGERATINCKSSQSLLHSGNQYNYLTWYQQKPGQPPKLLIYWASTRESGVPDRFTGSGSGTDF
TLTISSLQAEDVAVYYCQNDYTYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 25

>XENP33043 TBRII-B[TGFßRII]_H1_VHH-mAb C[PD1]_H1_L1.1_scFv(GKPGS)4-Fc(216)_IgG1_pI(-)_Isosteric_A_C220S/PVA_/S267K/L368D/K370S-Fc(216)_IgG1_C220S/PVA_/S267K/S364K/E357Q

Chain 1 - TBRII-B[TGFßRII]_H1_VHH_Fc(216)_IgG1_pI(-)_Isosteric_A_C220S/PVA_/S267K/L368D/K370S (SEQ ID NO: 2053)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - mAb C[PD1]_H1_L1.1_scFv(GKPGS)4_Fc(216)_IgG1_C220S/PVA_/S267K/S364K/E357Q (SEQ ID NO: 2054)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/GKPGSGKPGSGKPGSGKPGS/DIVMTQSPDSLAV
SLGERATINCKSSQSLLHSGNQKNYLTWYQQKPGQPPKLLIYWASTRESGVPDRFTGSGSGTDFTLTISSLQAEDVA
VYYCQNDYSYPFTFGSGTKLEIK/EPKSSDKTHTCPPCPAPPVAGPSVFLFPPKPKDTLMISRTPEVTCVVVDVKHE
DPEVKFNWYVDGVEVHNAKTKPREEQYNSTYRVVSVLTVLHQDWLNGKEYKCKVSNKALPAPIEKTISKAKGQPREP
QVYTLPPSREQMTKNQVKLTCLVKGFYPSDIAVEWESNGQPENNYKTTPPVLDSDGSFFLYSKLTVDKSRWQQGNVF
SCSVMHEALHNHYTQKSLSLSPGK

Figure 26

>XENP33046 TBRII-B[TGFßRII]_H1_VHH-mAb C[PD1]_H1_L1.1_Fab-Fc(216)_IgG1_pI(-)_Isosteric_A_C220S/PVA_/S267K/L368D/K370S-IgG1_PVA_/S267K /S364K/E357Q

Chain 1 - mAb C[PD1]_H1_IgG1_PVA_/S267K /S364K/E357Q (SEQ ID NO: 2055)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

Chain 2 - TBRII-B[TGFßRII]_H1_VHH_Fc(216)_IgG1_pI(-)_Isosteric_A_C220S/PVA_/S267K/L368D/K370S (SEQ ID NO: 2056)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 3 - mAb C[PD1]_L1.1 Light Chain (SEQ ID NO: 2057)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

>XENP33047 mAb C[PD1]_H1_L1.1_Fab-TBRII-B[TGFßRII]_H1_VHH-IgG1_pI(-)_Isosteric_A_PVA_/S267K/L368D/K370S-Fc(216)_IgG1_C220S/PVA_/S267K/S364K/E357Q

Chain 1 - mAb C[PD1]_H1_IgG1_pI(-)_Isosteric_A_PVA_/S267K/L368D/K370S (SEQ ID NO: 2058)

EVQLVESGGGLVQPGGSLRLSCAASGFTFSSFGMHWVRQAPGKGLEWVSYISSGSSIIYYADSVKGRFTISRDNAKN
SLYLQMNSLRAEDTAVYYCARGGRLVWSPDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-B[TGFßRII]_H1_VHH_Fc(216)_IgG1_C220S/PVA_/S267K/S364K/E357Q (SEQ ID NO: 2059)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK

Chain 3 - mAb C[PD1]_L1.1 Light Chain (SEQ ID NO: 2060)

DIVMTQSPDSLAVSLGERATINCKSSQSLLHSGNQKNYLTWYQQKPGQPPKLLIYWASTRESGVPDRFTGSGSGTDF
TLTISSLQAEDVAVYYCQNDYSYPFTFGSGTKLEIK/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 27A

>XENP34300 TBRII-C[TGFßRII]_H1L1_Fab-Numax_VHVL_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - TBRII-C[TGFßRII]_H1_IgG1_pI(-)_Isosteric_A_PVA_/S267K/L368D/K370S (SEQ ID NO: 2061)

EVQLVESGGGLVKPGGSLRLSCAASGFTFSSFSMNWVRQAPGKGLEWVSSISSSSSYIYYTDSVKGRFTISRDNAKN
SLYLQMNSLRAEDTAVYYCARGYWGFDYWGQGTLVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK

Chain 2 - Numax_VHVL_scFv(GKPGS)4_Fc(216)_IgG1_C220S/PVA_/S267K/S364K/E357Q (SEQ ID NO: 2062)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/GKPGSGKPGSGKPGSGKPGS/DIQMTQSPSTLS
ASVGDRVTITCSASSRVGYMHWYQQKPGKAPKLLIYDTSKLASGVPSRFSGSGSGTEFTLTISSLQPDDFATYYCFQ
GSGYPFTFGGGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - TBRII-C[TGFßRII]_L1 Light Chain (SEQ ID NO: 2063)

DIQMTQSPSSLSASVGDRVTITCRASQGIRNDLGWYQQKPGKAPKRLIYAASSLQSGVPSRFSGSASGTEFTLTISS
LQPEDFATYYCLQHNSNPLTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP34301 TBRII-A[TGFßRII]_H1L1_Fab-Numax_VHVL_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - TBRII-A[TGFßRII]_H1_IgG1_pI(-)_Isosteric_A_PVA_/S267K/L368D/K370S (SEQ ID NO: 2064)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - Numax_VHVL_scFv(GKPGS)4_Fc(216)_IgG1_C220S/PVA_/S267K/S364K/E357Q (SEQ ID NO: 2065)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/GKPGSGKPGSGKPGSGKPGS/DIQMTQSPSTLS
ASVGDRVTITCSASSRVGYMHWYQQKPGKAPKLLIYDTSKLASGVPSRFSGSGSGTEFTLTISSLQPDDFATYYCFQ
GSGYPFTFGGGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - TBRII-A[TGFßRII]_L1 Light Chain (SEQ ID NO: 2066)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 27B

>XENP34302 TBRII-A[TGFßRII]_H1.1_L1_Fab-Numax_VHVL_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - TBRII-A[TGFßRII]_H1.1_IgG1_pI(-)_Isosteric_A_PVA_/S267K/L368D/K370S (SEQ ID NO: 2067)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 - Numax_VHVL_scFv(GKPGS)4_Fc(216)_IgG1_C220S/PVA_/S267K/S364K/E357Q (SEQ ID NO: 2068)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/GKPGSGKPGSGKPGSGKPGS/DIQMTQSPSTLS
ASVGDRVTITCSASSRVGYMHWYQQKPGKAPKLLIYDTSKLASGVPSRFSGSGSGTEFTLTISSLQPDDFATYYCFQ
GSGYPFTFGGGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - TBRII-A[TGFßRII]_L1 Light Chain (SEQ ID NO: 2069)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP34303 TBRII-B[TGFßRII]_H1_VHH-Numax_Fab-Fc(216)_IgG1_pI(-)_Isosteric_A_C220S/PVA_/S267K/L368D/K370S-IgG1_PVA_/S267K/S364K/E357Q

Chain 1 - Numax_IgG1_PVA_/S267K/S364K/E357Q (SEQ ID NO: 2070)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

Chain 2 - TBRII-B[TGFßRII]_H1_VHH_Fc(216)_IgG1_pI(-)_Isosteric_A_C220S/PVA_/S267K/L368D/K370S (SEQ ID NO: 2071)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 3 – Numax Light Chain (SEQ ID NO: 2072)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27C

>XENP34304 Numax_Fab-TBRII-B[TGFßRII]_H1_VHH-IgG1_pI(-)_Isosteric_A_PVA_/S267K/L368D/K370S-Fc(216)_IgG1_C220S/PVA_/S267K/S364K/E357Q

Chain 1 - Numax_IgG1_pI(-)_Isosteric_A_PVA_/S267K/L368D/K370S (SEQ ID NO: 2073)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-B[TGFßRII]_H1_VHH_Fc(216)_IgG1_C220S/PVA_/S267K/S364K/E357Q (SEQ ID NO: 2074)
EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK

Chain 3 – Numax Light Chain (SEQ ID NO: 2075)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP34305 Numax_Fab-TBRII-A[TGFßRII]_H1L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 – Numax_IgG1_pI(-)_Isosteric_A_PVA_/S267K/L368D/K370S (SEQ ID NO: 2076)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1L1_scFv(GKPGS)4_Fc(216)_IgG1_C220S/PVA_/S267K/S364K/E357Q (SEQ ID NO: 2077)
QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 – Numax Light Chain (SEQ ID NO: 2078)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27D

>XENP34306 Numax_Fab-TBRII-A[TGFßRII]_H1.1_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 – Numax_IgG1_pI(-)_Isosteric_A_PVA_/S267K/L368D/K370S (SEQ ID NO: 2079)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2080)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 – Numax Light Chain (SEQ ID NO: 2081)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP34307 Numax_Fab-TBRII-C[TGFßRII]_H1L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 – Numax_IgG1_pI(-)_Isosteric_A_PVA_/S267K/L368D/K370S (SEQ ID NO: 2082)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-C[TGFßRII]_H1L1_scFv(GKPGS)4_Fc(216)_IgG1_C220S/PVA_/S267K/S364K/E357Q (SEQ ID NO: 2083)

EVQLVESGGGLVKPGGSLRLSCAASGFTFSSFSMNWVRQAPGKGLEWVSSISSSSSYIYYTDSVKGRFTISRDNAKN
SLYLQMNSLRAEDTAVYYCARGYWGFDYWGQGTLVTVSS/GKPGSGKPGSGKPGSGKPGS/DIQMTQSPSSLSASVG
DRVTITCRASQGIRNDLGWYQQKPGKAPKRLIYAASSLQSGVPSRFSGSASGTEFTLTISSLQPEDFATYYCLQHNS
NPLTFGGGTKVEIK/EPKSSDKTHTCPPCPAPPVAGPSVFLFPPKPKDTLMISRTPEVTCVVVDVKHEDPEVKFNWY
VDGVEVHNAKTKPREEQYNSTYRVVSVLTVLHQDWLNGKEYKCKVSNKALPAPIEKTISKAKGQPREPQVYTLPPSR
EQMTKNQVKLTCLVKGFYPSDIAVEWESNGQPENNYKTTPPVLDSDGSFFLYSKLTVDKSRWQQGNVFSCSVMHEAL
HNHYTQKSLSLSPGK

Chain 3 – Numax Light Chain (SEQ ID NO: 2084)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27E

>XENP35119 Numax_Fab-TBRII-A[TGFßRII]_H1.21_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2085)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.21_L1_scFv(GKPGS)4_Fc(216)_IgG1_C220S/PVA_/S267K/S364K/E357Q (SEQ ID NO: 2086)
QLQVQESGPGLVKPSETLSLTCTVSGGSISNSAFSWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2087)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP35120 Numax_Fab-TBRII-A[TGFßRII]_H1.29_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2088)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.29_L1_scFv(GKPGS)4_Fc(216)_IgG1_C220S/PVA_/S267K/S364K/E357Q (SEQ ID NO: 2089)
QLQVQESGPGLVKPSETLSLTCTVSGGSISNSYFTWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2090)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27F

>XENP35121 Numax_Fab-TBRII-A[TGFßRII]_H1.30_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2091)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2092)
QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2093)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP35122 Numax_Fab-TBRII-A[TGFßRII]_H1.33_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2094)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.33_L1_scFv(GKPGS)4_Fc(216)_IgG1_C220S/PVA_/S267K/S364K/E357Q (SEQ ID NO: 2095)
QLQVQESGPGLVKPSETLSLTCTVSGGSISNSYFSWAWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2096)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27G

>XENP35123 Numax_Fab-TBRII-A[TGFßRII]_H1.36_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2097)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.36_L1_scFv(GKPGS)4_Fc(216)_IgG1_C220S/PVA_/S267K/S364K/E357Q (SEQ ID NO: 2098)
QLQVQESGPGLVKPSETLSLTCTVSGGSISNSYFSWSWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2099)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC >XENP35124 Numax_Fab-TBRII-A[TGFßRII]_H1.37_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2100)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.37_L1_scFv(GKPGS)4_Fc(216)_IgG1_C220S/PVA_/S267K/S364K/E357Q (SEQ ID NO: 2101)
QLQVQESGPGLVKPSETLSLTCTVSGGSISNSYFSWGWVRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2102)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27H

>XENP35125 Numax_Fab-TBRII-A[TGFßRII]_H1.51_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2103)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2104)
QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2105)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP35126 Numax_Fab-TBRII-A[TGFßRII]_H1.56_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2106)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.56_L1_scFv(GKPGS)4_Fc(216)_IgG1_C220S/PVA_/S267K/S364K/E357Q (SEQ ID NO: 2107)
QLQVQESGPGLVKPSETLSLTCTVSGGSISNSYFSWGWIRQPPGKGLEWIGSFYYGGKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2108)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27I

>XENP35127 Numax_Fab-TBRII-A[TGFßRII]_H1.48_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2109)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.48_L1_scFv(GKPGS)4_Fc(216)_IgG1_C220S/PVA_/S267K/S364K/E357Q (SEQ ID NO: 2110)
QLQVQESGPGLVKPSETLSLTCTVSGGSISNSYFSWGWIRQPPGKGLEWIGSFDYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2111)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP35128 Numax_Fab-TBRII-A[TGFßRII]_H1.50_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2112)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.50_L1_scFv(GKPGS)4_Fc(216)_IgG1_C220S/PVA_/S267K/S364K/E357Q (SEQ ID NO: 2113)
QLQVQESGPGLVKPSETLSLTCTVSGGSISNSYFSWGWIRQPPGKGLEWIGSFKYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Numax Light Chain (SEQ ID NO: 2114)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27J

XENP35379 Numax_Fab-TBRII-A[TGF RII]_L1_H1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_VH_IgG1_pI(-)_Isosteric_A_PVA_/S267K/L368D/K370S (SEQ ID NO: 2115)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_L1_H1.1_scFv(GKPGS)4_Fc(216)_IgG1_C220S/PVA_/S267K/S364K/E357Q (SEQ ID NO: 2116)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIKGKPGSGKPGSGKPGSGKPGSQLQVQESGPGLVKPSETLSLTCTVSGG
SISNSYFSWGWIRQPPGKGLEWIGSFYYGEKTYYNPSLKSRATISIDTSKSQFSLKLSSVTAADTAVYYCPRGPTVI
RGVIDSWGQGTLVTVSS/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Numax Light Chain (SEQ ID NO: 2117)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP36979 Numax_Fab-TBRII-A[TGF RII]_H1.189_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_IgG1_pI(-)_Isosteric_A_PVA_/S267K/L368D/K370S (SEQ ID NO: 2118)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.189_L1_scFv(GKPGS)4_Fc(216)_IgG1_C220S/PVA_/S267K/S364K/E357Q (SEQ ID NO: 2119)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Numax Light Chain (SEQ ID NO: 2120)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27K

XENP36980 Numax_Fab-TBRII-A[TGF RII]_H1.190_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_IgG1_pI(-)_Isosteric_A_PVA_/S267K/L368D/K370S (SEQ ID NO: 2121)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.190_L1_scFv(GKPGS)4_Fc(216)_IgG1_C220S/PVA_/S267K/S364K/E357Q (SEQ ID NO: 2122)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Numax Light Chain (SEQ ID NO: 2123)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP36981 Numax_Fab-TBRII-A[TGF RII]_H1.201_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - Numax_IgG1_pI(-)_Isosteric_A_PVA_/S267K/L368D/K370S (SEQ ID NO: 2124)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.201_L1_scFv(GKPGS)4_Fc(216)_IgG1_C220S/PVA_/S267K/S364K/E357Q (SEQ ID NO: 2125)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Numax Light Chain (SEQ ID NO: 2126)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 27L

XENP36982 5D7[CD5]_H1L1_Fab-TBRII-A[TGF RII]_H1.189_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1IgG1_pI(-)_Isosteric_A_PVA_/S267K/L368D/K370S (SEQ ID NO: 2127)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.189_L1_scFv(GKPGS)4_Fc(216)_IgG1_C220S/PVA_/S267K/S364K/E357Q (SEQ ID NO: 2128)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2129)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP39137 Numax_Fab-TBRII-A[TGF RII]_H1.212_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Numax_VH_IgG1_pI(-)_Isosteric_A_/PVA_/S267K/L368D/K370S (SEQ ID NO: 2130)

QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.212_L1_scFv(GKPGS)4_Fc(216)_IgG1_C220S/PVA_/S267K/S364K/E357Q (SEQ ID NO: 2131)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Numax Light Chain (SEQ ID NO: 2132)

DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 29A

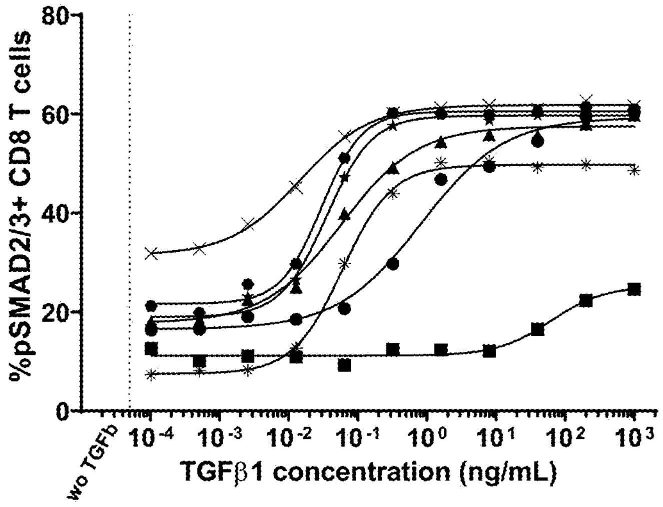

No TA [EC50 = 0.06034]
XENP33038 bivalent αTGFßRII (TBRII-C_H1L1) [EC50 = 0.05732]
XENP33040 bivalent αTGFßRII (TBRII-B_42_H1) [EC50 = 62.34]
XENP28297 bivalent αTGFßRII (TBRII-A_H1.1_L1) [EC50 = 0.8274]
(E-6): sc-17792 [EC50 = 0.02980]
(D-2): sc-17799 [EC50 = 0.03538]
XENP16432 bivalent αPD1 (nivolumab KO) [EC50 = 0.01457]

Figure 29B

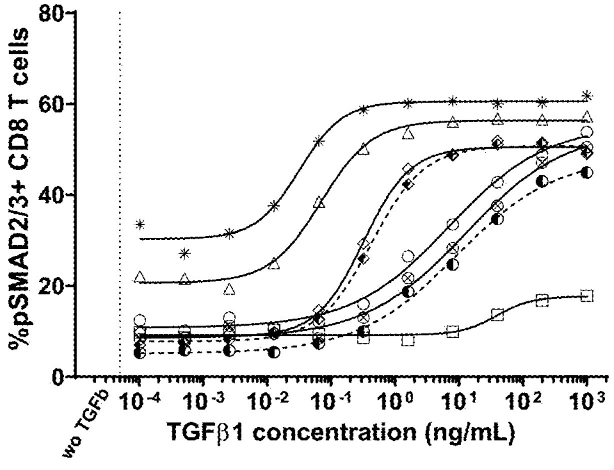

No TA [EC50 = 0.03184]
XENP33041 αTGFßRII (TBRII-C_H1L1) x Anti-PD1 (mAb C) [EC50 = 0.06998]
XENP33047 αTGFßRII (TBRII-B_42_H1) x Anti-PD1 (mAb C) [EC50 = 38.78]
XENP33045 αTGFßRII (TBRII-A_H1.1_L1; Fab) x Anti-PD1 (mAb C; scFv) [EC50 = 7.079]
XENP34288 αPD1 (mAb C; Fab) x αTGFßRII (TBRII-A_H1.1_L1; scFv) [EC50 = 12.47]
XENP34306 αRSV x αTGFßRII (TBRII-A_H1.1_L1) [EC50 = 0.3202]
XENP16432bivalent αPD1 (nivolumab KO) + XENP34288 [EC50 = 12.47]
XENP16432 bivalent αPD1 (nivolumab KO) + XENP34306 [EC50 = 0.4251]

Figure 32A

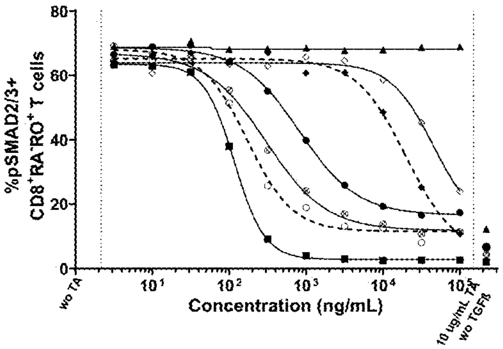

—▲— XENP33041 aTGFßRII (TBRII-C_H1L1) x Anti-PD1 (mAb C) [EC50 = 58.46]
—■— XENP33047 aTGFßRII (TBRII-B_42_H1) x Anti-PD1 (mAb C) [EC50 = 116.3]
—●— XENP33045 aTGFßRII (TBRII-A_H1.1_L1; Fab) x Anti-PD1 (mAb C; scFv) [EC50 = 818.9]
- -○- - XENP34287 aPD1 (mAb C; Fab) x aTGFßRII (TBRII-A_H1L1; scFv) [EC50 = 172.5]
—◈— XENP34288 aPD1 (mAb C; Fab) x aTGFßRII (TBRII-A_H1.1_L1; scFv) [EC50 = 302.4]
- -◆- - XENP34305 aRSV (Fab) x aTGFßRII (TBRII-A_H1L1; scFv) [EC50 = 19919]
—◇— XENP34306 aRSV (Fab) x aTGFßRII (TBRII-A_H1.1_L1; scFv) [EC50 = 44905]

Figure 32B

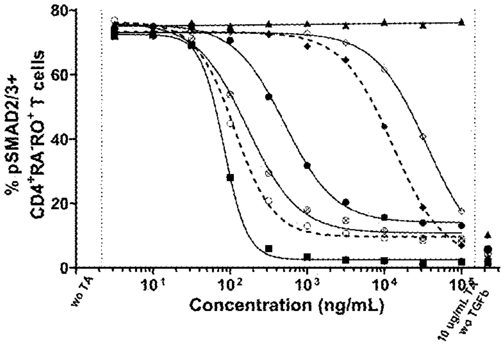

—▲— XENP33041 aTGFßRII (TBRII-C_H1L1) x Anti-PD1 (mAb C) [EC50 = 8669]
—■— XENP33047 aTGFßRII (TBRII-B_42_H1) x Anti-PD1 (mAb C) [EC50 = 82.96]
—●— XENP33045 aTGFßRII (TBRII-A_H1.1_L1; Fab) x Anti-PD1 (mAb C; scFv) [EC50 = 507.4]
- -○- - XENP34287 aPD1 (mAb C; Fab) x aTGFßRII (TBRII-A_H1L1; scFv) [EC50 = 114.3]
—◈— XENP34288 aPD1 (mAb C; Fab) x aTGFßRII (TBRII-A_H1.1_L1; scFv) [EC50 = 167.2]
- -◆- - XENP34305 aRSV (Fab) x aTGFßRII (TBRII-A_H1L1; scFv) [EC50 = 12971]
—◇— XENP34306 aRSV (Fab) x aTGFßRII (TBRII-A_H1.1_L1; scFv) [EC50 = 35965]

10 ng/mL TGFb

—★— XENP28297 bivalent αTGFßRII (TBRII-A_H1.1_L1) [EC50 = 417.0]
—●— XENP34288 aPD1 (mAb C; Fab) x aTGFßRII (TBRII-A_H1.1_L1; scFv)
—×— XENP34306 aRSV (Fab) x aTGFßRII (TBRII-A_H1.1_L1; scFv) [EC50 = 1114]

100 ng/mL TGFß

—★— XENP28297 bivalent αTGFßRII (TBRII-A_H1.1_L1) [EC50 = 40548]
—●— XENP34288 aPD1 (mAb C; Fab) x aTGFßRII (TBRII-A_H1.1_L1; scFv) [EC50 = 3284]
—×— XENP34306 aRSV (Fab) x aTGFßRII (TBRII-A_H1.1_L1; scFv)

Figure 42A

| | | | | scFv | | Fab | |
|---|---|---|---|---|---|---|---|
| | | VH Variants | VL Variants | XENP | Tm | XENP | Tm |
| H1 | L1 | WT | WT | 34735 | 59 | 28298 | 74.5 |
| H1.1 | L1 | M109V (98) | WT | 34736 | 58 | 28299 | 74 |
| H1.2 | L1 | L2V (2) | WT | 34737 | 59 | 34458 | 74.5 |
| H1.3 | L1 | L2V/V4L (2/4) | WT | 34738 | | 34459 | 73 |
| H1.4 | L1 | V4L (4) | WT | 34739 | | 34460 | 73 |
| H1.5 | L1 | P9S (9) | WT | 34740 | | 34461 | 73 |
| H1.6 | L1 | E16Q (16) | WT | 34741 | | 34462 | 74 |
| H1.7 | L1 | T23A (23) | WT | 34742 | | 34463 | 72.5 |
| H1.8 | L1 | G27Y (27) | WT | 34743 | | 34464 | 73 |
| H1.9 | L1 | I29F (29) | WT | 34744 | | 34465 | 73.5 |
| H1.10 | L1 | I29V (29) | WT | 34745 | | 34466 | 73.5 |
| H1.11 | L1 | N31D (31) | WT | 34746 | 59.5 | 34467 | 31.5; 75.0 |
| H1.12 | L1 | N31E (31) | WT | 34747 | | 34468 | 73.5 |
| H1.13 | L1 | N31G (31) | WT | 34748 | | 34469 | 73 |
| H1.14 | L1 | N31S (31) | WT | 34749 | | 34470 | 74 |
| H1.15 | L1 | N31T (31) | WT | 34750 | | 34471 | 73.5 |
| H1.16 | L1 | N31Q (31) | WT | 34751 | | 34472 | 73 |
| H1.17 | L1 | N31R (31) | WT | 34752 | | 34473 | 72.5 |
| H1.18 | L1 | S32A (32) | WT | 34753 | 58.5 | 34474 | 74.5 |
| H1.19 | L1 | S32G (32) | WT | 34754 | | 34475 | 74 |
| H1.20 | L1 | S32T (32) | WT | 34755 | 58.5 | 34476 | 74.5 |
| H1.21 | L1 | Y33A (33) | WT | 34756 | 60.5 | 34477 | 27.5; 75.0 |
| H1.22 | L1 | Y33D (33) | WT | 34757 | 60 | 34478 | 27.5; 75.0 |
| H1.23 | L1 | Y33G (33) | WT | 34758 | 59 | 34479 | 74.5 |
| H1.24 | L1 | Y33H (33) | WT | 34759 | 59.5 | 34480 | 74.5 |
| H1.25 | L1 | F34H (34) | WT | 34760 | | 34481 | 73 |
| H1.26 | L1 | F34S (34) | WT | 34761 | | 34482 | 72 |
| H1.27 | L1 | F34Y (34) | WT | 34762 | 60 | 34483 | 75 |
| H1.28 | L1 | S35A (35) | WT | 34763 | | 34484 | 74 |
| H1.29 | L1 | S35T (35) | WT | 34764 | 60 | 34485 | 75.5 |
| H1.30 | L1 | S35Y (35) | WT | 34765 | 62 | 34486 | 77 |
| H1.31 | L1 | W36I (35a) | WT | 34766 | | 34487 | 71 |
| H1.32 | L1 | W36M (35a) | WT | 34767 | 62.5 | 34488 | 71 |
| H1.33 | L1 | G37A (35b) | WT | 34768 | 66 | 34489 | 78 |
| H1.34 | L1 | G37H (35b) | WT | 34769 | | 34490 | 81.5 |
| H1.35 | L1 | G37N (35b) | WT | 34770 | | 34491 | 81 |
| H1.36 | L1 | G37S (35b) | WT | 34771 | 62 | 34492 | 78.5 |

Figure 42B

| | | | | scFv | | Fab | |
|---|---|---|---|---|---|---|---|
| | | VH Variants | VL Variants | XENP | Tm | XENP | Tm |
| H1.37 | L1 | I39V (37) | WT | 34772 | 60 | 34493 | 75.5 |
| H1.38 | L1 | P42A (40) | WT | 34773 | 59.5 | 34494 | 75 |
| H1.39 | L1 | P42H (40) | WT | 34774 | 59.5 | 34495 | 75 |
| H1.40 | L1 | I50V (48) | WT | 34775 | | 34496 | 72.5 |
| H1.41 | L1 | S52E (50) | WT | 34776 | | 34497 | 72 |
| H1.42 | L1 | S52N (50) | WT | 34777 | | 34498 | 73.5 |
| H1.43 | L1 | S52T (50) | WT | 34778 | | 34499 | 73 |
| H1.44 | L1 | S52V (50) | WT | 34779 | | 34500 | 74 |
| H1.45 | L1 | S52Y (50) | WT | 34780 | | 34501 | 74 |
| H1.46 | L1 | F53I (51) | WT | 34781 | | 34502 | 74 |
| H1.47 | L1 | F53V (51) | WT | 34782 | | 34503 | 73.5 |
| H1.48 | L1 | Y54D (52) | WT | 34783 | | 34504 | 74 |
| H1.49 | L1 | Y54H (52) | WT | 34784 | 60 | 34505 | 75 |
| H1.50 | L1 | Y54K (52) | WT | 34785 | 60.5 | 34506 | 74.5 |
| H1.51 | L1 | Y54N (52) | WT | 34786 | 60 | 34507 | 75 |
| H1.52 | L1 | Y54S (52) | WT | 34787 | | 34508 | 77 |
| H1.53 | L1 | Y55H (53) | WT | 34788 | | 34509 | 74 |
| H1.54 | L1 | Y55S (53) | WT | 34789 | | 34510 | 30; 73.5 |
| H1.55 | L1 | G56S (54) | WT | 34790 | | 34511 | 72 |
| H1.56 | L1 | E60G (55) | WT | 34791 | 60.5 | 34512 | 76 |
| H1.57 | L1 | E60S (55) | WT | 34792 | 60 | 34513 | 75 |
| H1.58 | L1 | K61D (56) | WT | 34793 | 58.5 | 34514 | 74.5 |
| H1.59 | L1 | K61N (56) | WT | 34794 | | 34515 | 74 |
| H1.60 | L1 | K61S (56) | WT | 34795 | | 34516 | 74 |
| H1.61 | L1 | T62I (57) | WT | 34796 | 61 | 34517 | 76.5 |
| H1.62 | L1 | Y63F (58) | WT | 34797 | | 34518 | 73.5 |
| H1.63 | L1 | Y63H (58) | WT | 34798 | | 34519 | 73 |
| H1.64 | L1 | Y63N (58) | WT | 34799 | | 34520 | 72.5 |
| H1.65 | L1 | Y63S (58) | WT | 34800 | | 34521 | 73 |
| H1.66 | L1 | N65A (60) | WT | 34801 | | 34522 | 73.5 |
| H1.67 | L1 | N65S (60) | WT | 34802 | | 34523 | 73 |
| H1.68 | L1 | K69E (64) | WT | 34803 | | 34524 | 74 |
| H1.69 | L1 | K69Q (64) | WT | 34804 | | 34525 | 74 |
| H1.70 | L1 | S70G (65) | WT | 34805 | 59.5 | 34526 | 75 |
| H1.71 | L1 | A72F (67) | WT | 34806 | | 34527 | 68.5 |
| H1.72 | L1 | A72V (67) | WT | 34807 | | 34528 | 73.5 |
| H1.73 | L1 | I76V (71) | WT | 34808 | 59 | 34529 | 74.5 |
| H1.74 | L1 | S81N (76) | WT | 34809 | 62.5 | 34530 | 77 |

Figure 42C

| | | | | scFv | | Fab | |
|---|---|---|---|---|---|---|---|
| | | VH Variants | VL Variants | XENP | Tm | XENP | Tm |
| H1.75 | L1 | K86Q (81) | WT | 34810 | | 34531 | 74 |
| H1.76 | L1 | A93E (85) | WT | 34811 | 59.5 | 34532 | 74.5 |
| H1.77 | L1 | A93V (85) | WT | 34812 | | 34533 | 72 |
| H1.78 | L1 | P101A (93) | WT | 34813 | 67.5 | 34534 | 82 |
| H1.79 | L1 | T108A (97) | WT | 34814 | | 34535 | 75 |
| H1.80 | L1 | T108D (97) | WT | 34815 | | 34536 | 73 |
| H1.81 | L1 | T108N (97) | WT | 34816 | | 34537 | 73.5 |
| H1.82 | L1 | T108S (97) | WT | 34817 | 59 | 34538 | 74.5 |
| H1.83 | L1 | M109A (98) | WT | 34818 | 60 | 34539 | 75 |
| H1.84 | L1 | M109E (98) | WT | 34819 | 59 | 34540 | 74.5 |
| H1.85 | L1 | M109S (98) | WT | 34820 | 60 | 34541 | 75 |
| H1.86 | L1 | M109T (98) | WT | 34821 | 59 | 34542 | 74.5 |
| H1.87 | L1 | M109Q (98) | WT | 34822 | 59.5 | 34543 | 74.5 |
| H1.88 | L1 | I110A (99) | WT | 34823 | | 34544 | 73 |
| H1.89 | L1 | I110D (99) | WT | 34824 | | 34545 | 71 |
| H1.90 | L1 | I110N (99) | WT | 34825 | | 34546 | 72.5 |
| H1.91 | L1 | I110V (99) | WT | 34826 | | 34547 | 73.5 |
| H1.92 | L1 | R111A (100) | WT | 34827 | | 34548 | 74.5 |
| H1.93 | L1 | R111H (100) | WT | 34828 | | 34549 | 74 |
| H1.94 | L1 | R111E (100) | WT | 34829 | | 34550 | 72.5 |
| H1.95 | L1 | R111K (100) | WT | 34830 | 59 | 34551 | 74.5 |
| H1.96 | L1 | R111Q (100) | WT | 34831 | | 34552 | 74 |
| H1.97 | L1 | R111S (100) | WT | 34832 | | 34553 | 73.5 |
| H1.98 | L1 | V113A (100b) | WT | 34833 | | 34554 | 71.5 |
| H1.99 | L1 | V113S (100b) | WT | 34834 | | 34555 | 69.5; 74.0 |
| H1.100 | L1 | I114F (100c) | WT | 34835 | 63 | 34556 | 78 |
| H1.101 | L1 | I114M (100c) | WT | 34836 | 61.5 | 34557 | 76.5 |
| H1.102 | L1 | S116H (102) | WT | 34837 | 60 | 34558 | 75.5 |
| H1.103 | L1 | S116L (102) | WT | 34838 | 58.5 | 34559 | 74.5 |
| H1.104 | L1 | S116V (102) | WT | 34839 | 58.5 | 34560 | 74.5 |
| H1.105 | L1 | S116Y (102) | WT | 34840 | 60.5 | 34561 | 76 |
| H1.106 | L1 | L122M (108) | WT | 34841 | | 34562 | 74 |
| H1.107 | L1 | L122T (108) | WT | 34842 | | 34563 | 72 |
| H1 | L1.1 | WT | L4M (4) | 34843 | | 34564 | 72.5 |
| H1 | L1.2 | WT | A9G (9) | 34844 | | 34565 | 74 |
| H1 | L1.3 | WT | A9P (9) | 34845 | 59 | 34566 | 74.5 |

Figure 42D

| | | | | scFv | | Fab | |
|---|---|---|---|---|---|---|---|
| | | VH Variants | VL Variants | XENP | Tm | XENP | Tm |
| H1 | L1.4 | WT | L13V (13) | 34846 | 58.5 | 34567 | 75 |
| H1 | L1.5 | WT | A19V (19) | 34847 | | 34568 | 73 |
| H1 | L1.6 | WT | R24G (24) | 34848 | | 34569 | 72 |
| H1 | L1.7 | WT | S28G (28) | 34849 | | 34570 | 73 |
| H1 | L1.8 | WT | R30K (30) | 34850 | 59.5 | 34571 | 74.5 |
| H1 | L1.9 | WT | R30Q (30) | 34851 | 59.5 | 34572 | 75 |
| H1 | L1.10 | WT | R30S (30) | 34852 | 59 | 34573 | 74.5 |
| H1 | L1.11 | WT | S37N (31) | 34853 | 60 | 34574 | 75 |
| H1 | L1.12 | WT | S37T (31) | 34854 | 59.5 | 34575 | 75 |
| H1 | L1.13 | WT | Y38H (32) | 34855 | | 34576 | 73.5 |
| H1 | L1.14 | WT | Y38N (32) | 34856 | | 34577 | 72.5 |
| H1 | L1.15 | WT | A40N (34) | 34857 | 59.5 | 34578 | 74.5 |
| H1 | L1.16 | WT | A40S (34) | 34858 | | 34579 | 74 |
| H1 | L1.17 | WT | A40T (34) | 34859 | | 34580 | 72.5 |
| H1 | L1.18 | WT | Q48K (42) | 34860 | 59.5 | 34581 | 74.5 |
| H1 | L1.19 | WT | Q48L (42) | 34861 | | 34582 | 74 |
| H1 | L1.20 | WT | D56E (50) | 34862 | | 34583 | 72 |
| H1 | L1.21 | WT | D56G (50) | 34863 | | 34584 | 69.5 |
| H1 | L1.22 | WT | D56S (50) | 34864 | | 34585 | 68.5 |
| H1 | L1.23 | WT | N59D (53) | 34865 | | 34586 | 71 |
| H1 | L1.24 | WT | N59S (53) | 34866 | | 34587 | 73 |
| H1 | L1.25 | WT | N59T (53) | 34867 | | 34588 | 73.5 |
| H1 | L1.26 | WT | T62S (56) | 34868 | 59 | 34589 | 74.5 |
| H1 | L1.27 | WT | G63S (57) | 34869 | | 34590 | 73 |
| H1 | L1.28 | WT | I64V (58) | 34870 | 59.5 | 34591 | 74.5 |
| H1 | L1.29 | WT | A66D (60) | 34871 | 59 | 34592 | 74.5 |
| H1 | L1.30 | WT | D76E (70) | 34872 | 59 | 34593 | 74.5 |
| H1 | L1.31 | WT | S83R (77) | 34873 | | 34594 | 74 |
| H1 | L1.32 | WT | E85Q (79) | 34874 | 59 | 34595 | 35; 75 |
| H1 | L1.33 | WT | P86S (80) | 34875 | | 34596 | 73.5 |
| H1 | L1.34 | WT | E85Q/P86S (79/80) | 34876 | | 34597 | 73.5 |
| H1 | L1.35 | WT | V91T (85) | 34877 | 59.5 | 34598 | 74.5 |
| H1 | L1.36 | WT | R97E (91) | 34878 | | 34599 | 67.5 |
| H1 | L1.37 | WT | R97K (91) | 34879 | | 34600 | 69 |
| H1 | L1.38 | WT | R97S (91) | 34880 | | 34601 | 74 |
| H1 | L1.39 | WT | R97Q (91) | 34881 | | 34602 | 73.5 |
| H1 | L1.40 | WT | R97Y (91) | 34882 | 57.5; 81 | 34603 | 80 |

Figure 42E

| | | | | scFv | | Fab | |
|---|---|---|---|---|---|---|---|
| | | VH Variants | VL Variants | XENP | Tm | XENP | Tm |
| H1 | L1.41 | WT | S98A (92) | 34883 | 60 | 34604 | 75.5 |
| H1 | L1.42 | WT | S98G (92) | 34884 | | 34605 | 73 |
| H1 | L1.43 | WT | S98N (92) | 34885 | | 34606 | 73.5 |
| H1 | L1.44 | WT | S98T (92) | 34886 | | 34607 | 72.5 |
| H1 | L1.45 | WT | N99D (93) | 34887 | | 34608 | 74 |
| H1 | L1.46 | WT | N99S (93) | 34888 | 59.5 | 34609 | 75 |
| H1 | L1.47 | WT | N99Q (93) | 34889 | 59.5 | 34610 | 74.5 |
| H1 | L1.48 | WT | W100H (94) | 34890 | | 34611 | 72 |
| H1 | L1.49 | WT | W100V (94) | 34891 | | 34612 | 71.5 |
| H1 | L1.50 | WT | W100I (94) | 34892 | | 34613 | 72.5 |
| H1 | L1.51 | WT | W100L (94) | 34893 | | 34614 | 73 |
| H1 | L1.52 | WT | W100S (94) | 34894 | | 34615 | 70.5 |
| H1 | L1.53 | WT | W100Y (94) | 34895 | 57 | 34616 | 74.5 |
| H1 | L1.54 | WT | P104F (96) | 34896 | | 34617 | 78.5 |
| H1 | L1.55 | WT | P104I (96) | 34897 | 58.5 | 34618 | 75 |
| H1 | L1.56 | WT | P104L (96) | 34898 | | 34619 | 75 |
| H1 | L1.57 | WT | P104W (96) | 34899 | | 34620 | 78.5 |
| H1 | L1.58 | WT | P104Y (96) | 34900 | | 34621 | 78.5 |
| H1 | L1.59 | WT | Q108G (100) | 34901 | | 34622 | 74 |
| H1 | L1.60 | WT | Q108P (100) | 34902 | 59.5 | 34623 | 75 |
| H1 | L1.61 | WT | V112L (104) | 34903 | 59 | 34624 | 74.5 |

Figure 43

| | | | | x αPD-1 Fab | | x αRSV Fab | |
|---|---|---|---|---|---|---|---|
| | | **VH Variants** | **VL Variants** | **XENP** | **Tm1; Tm2** | **XENP** | **Tm1; Tm2** |
| H1 | L1 | WT | WT | 34287 | 60; 74 | 34305 | 59.5; 84.5 |
| H1.1 | L1 | M109V (98) | WT | 34288 | 59; 74 | 34306 | 59; 64.5 |
| H1.21 | L1 | Y33A (33) | WT | 35103 | 61; 74 | 35119 | 61.5; 84.5 |
| H1.29 | L1 | S35T (35) | WT | 35104 | 61; 74 | 35120 | 60.5; 84.5 |
| H1.30 | L1 | S35Y (35) | WT | 35105 | 63; 74.5 | 35121 | 62.5; 84.5 |
| H1.33 | L1 | G37A (35b) | WT | 35106 | 63; 74 | 35122 | 63; 84.5 |
| H1.36 | L1 | G37S (35b) | WT | 35107 | 63; 74.5 | 35123 | 63; 84.5 |
| H1.37 | L1 | I39V (37) | WT | 35108 | 61.5; 74 | 35124 | 61.5; 84.5 |
| H1.48 | L1 | Y54D (52) | WT | 35111 | 62; 74.5 | 35127 | 60; 84.5 |
| H1.50 | L1 | Y54K (52) | WT | 35112 | 61.5; 74 | 35128 | 61.5; 84.5 |
| H1.51 | L1 | Y54N (52) | WT | 35109 | 61.5; 74.5 | 35125 | 61.5; 85 |
| H1.56 | L1 | E60G (55) | WT | 35110 | 62; 74.5 | 35126 | 61.5; 84.5 |

Figure 44A

| | | VH Variants | VL Variants | Fab XENP | Response | $K_D$ (M) | $k_a$ (1/Ms) | $k_d$ (1/s) | Fold Change $K_D$ |
|---|---|---|---|---|---|---|---|---|---|
| H1 | L1 | WT | WT | 28298 | 0.046 | 1.00E-12 | 3.57E+06 | 1.00E-07 | 1 |
| H1.1 | L1 | M109V (98) | WT | 28299 | 0.0452 | 3.25E-10 | 4.37E+06 | 1.42E-03 | 325 |
| H1.2 | L1 | L2V (2) | WT | 34458 | 0.051 | 1.00E-12 | 3.14E+06 | 1.00E-07 | 1 |
| H1.3 | L1 | L2V/V4L (2/4) | WT | 34459 | 0.0472 | 1.00E-12 | 2.75E+06 | 1.00E-07 | 1 |
| H1.4 | L1 | V4L (4) | WT | 34460 | 0.0512 | 1.28E-10 | 2.26E+06 | 2.90E-04 | 128 |
| H1.5 | L1 | P9S (9) | WT | 34461 | 0.0519 | 2.45E-10 | 7.18E+06 | 1.76E-03 | 245 |
| H1.6 | L1 | E16Q (16) | WT | 34462 | 0.0457 | 2.42E-11 | 2.18E+06 | 5.28E-05 | 24 |
| H1.7 | L1 | T23A (23) | WT | 34463 | 0.0463 | 3.16E-10 | 3.28E+06 | 1.04E-03 | 316 |
| H1.8 | L1 | G27Y (27) | WT | 34464 | 0.0663 | 2.38E-10 | 1.91E+06 | 4.54E-04 | 238 |
| H1.9 | L1 | I29F (29) | WT | 34465 | 0.0494 | 4.96E-10 | 2.73E+06 | 1.35E-03 | 496 |
| H1.10 | L1 | I29V (29) | WT | 34466 | 0.0486 | 1.82E-10 | 3.32E+06 | 6.03E-04 | 182 |
| H1.11 | L1 | N31D (31) | WT | 34467 | 0.0458 | 4.19E-10 | 2.06E+06 | 8.62E-04 | 419 |
| H1.12 | L1 | N31E (31) | WT | 34468 | 0.0471 | 3.74E-10 | 2.92E+06 | 1.09E-03 | 374 |
| H1.13 | L1 | N31G (31) | WT | 34469 | 0.0285 | 1.00E-09 | 2.46E+06 | 2.47E-03 | 1004 |
| H1.14 | L1 | N31S (31) | WT | 34470 | 0.0437 | 1.81E-10 | 2.48E+06 | 4.50E-04 | 181 |
| H1.15 | L1 | N31T (31) | WT | 34471 | 0.0402 | 1.15E-11 | 2.29E+06 | 2.64E-05 | 12 |
| H1.16 | L1 | N31Q (31) | WT | 34472 | 0.0361 | 4.07E-10 | 3.35E+06 | 1.36E-03 | 407 |
| H1.17 | L1 | N31R (31) | WT | 34473 | 0.0304 | 2.92E-10 | 7.33E+06 | 2.14E-03 | 292 |
| H1.18 | L1 | S32A (32) | WT | 34474 | 0.0452 | 2.05E-10 | 2.48E+06 | 5.07E-04 | 205 |
| H1.19 | L1 | S32G (32) | WT | 34475 | 0.0496 | 8.36E-10 | 1.40E+06 | 1.17E-03 | 836 |
| H1.20 | L1 | S32T (32) | WT | 34476 | 0.0416 | 5.59E-10 | 6.89E+06 | 3.85E-03 | 559 |
| H1.21 | L1 | Y33A (33) | WT | 34477 | 0.0457 | 4.55E-10 | 1.77E+06 | 8.04E-04 | 455 |
| H1.22 | L1 | Y33D (33) | WT | 34478 | 0.0555 | 1.97E-09 | 1.41E+06 | 2.78E-03 | 1972 |
| H1.23 | L1 | Y33G (33) | WT | 34479 | 0.0429 | 7.67E-10 | 1.88E+06 | 1.44E-03 | 767 |
| H1.24 | L1 | Y33H (33) | WT | 34480 | 0.0516 | 1.99E-10 | 3.06E+06 | 6.07E-04 | 199 |
| H1.25 | L1 | F34H (34) | WT | 34481 | 0.0585 | 4.15E-10 | 3.15E+06 | 1.31E-03 | 415 |
| H1.26 | L1 | F34S (34) | WT | 34482 | 0.0488 | 2.73E-10 | 2.24E+06 | 6.12E-04 | 273 |
| H1.27 | L1 | F34Y (34) | WT | 34483 | 0.0653 | 8.09E-10 | 3.03E+06 | 2.45E-03 | 809 |
| H1.28 | L1 | S35A (35) | WT | 34484 | 0.0428 | 3.60E-09 | 2.20E+06 | 7.91E-03 | 3598 |
| H1.29 | L1 | S35T (35) | WT | 34485 | 0.0581 | 1.79E-09 | 3.22E+06 | 5.75E-03 | 1786 |
| H1.30 | L1 | S35Y (35) | WT | 34486 | 0.0549 | 5.90E-09 | 2.65E+06 | 1.56E-02 | 5895 |
| H1.31 | L1 | W36I (35a) | WT | 34487 | 0.0558 | 7.28E-09 | 1.85E+06 | 1.35E-02 | 7279 |
| H1.32 | L1 | W36M (35a) | WT | 34488 | 0.0505 | 2.47E-09 | 1.48E+06 | 3.64E-03 | 2466 |
| H1.33 | L1 | G37A (35b) | WT | 34489 | 0.0556 | 4.14E-10 | 3.10E+06 | 1.28E-03 | 414 |
| H1.34 | L1 | G37H (35b) | WT | 34490 | 0.0509 | 5.73E-09 | 7.13E+05 | 4.09E-03 | 5734 |
| H1.35 | L1 | G37N (35b) | WT | 34491 | 0.0092 | | | | |
| H1.36 | L1 | G37S (35b) | WT | 34492 | 0.0307 | 1.76E-09 | 1.55E+06 | 2.72E-03 | 1760 |
| H1.37 | L1 | I39V (37) | WT | 34493 | 0.0492 | 3.91E-10 | 3.32E+06 | 1.30E-03 | 391 |
| H1.38 | L1 | P42A (40) | WT | 34494 | 0.0434 | 3.25E-10 | 2.60E+06 | 8.47E-04 | 325 |

Figure 44B

| | | VH Variants | VL Variants | Fab XENP | Response | $K_D$ (M) | $k_a$ (1/Ms) | $k_d$ (1/s) | Fold Change $K_D$ |
|---|---|---|---|---|---|---|---|---|---|
| H1.39 | L1 | P42H (40) | WT | 34495 | 0.0568 | 4.25E-10 | 2.16E+06 | 9.18E-04 | 425 |
| H1.40 | L1 | I50V (48) | WT | 34496 | 0.0466 | 3.38E-10 | 2.48E+06 | 8.38E-04 | 338 |
| H1.41 | L1 | S52E (50) | WT | 34497 | 0.0463 | 1.89E-08 | 2.41E+06 | 4.55E-02 | 18860 |
| H1.42 | L1 | S52N (50) | WT | 34498 | 0.047 | 2.59E-09 | 2.74E+06 | 7.11E-03 | 2591 |
| H1.43 | L1 | S52T (50) | WT | 34499 | 0.0538 | 6.27E-10 | 3.64E+06 | 2.28E-03 | 627 |
| H1.44 | L1 | S52V (50) | WT | 34500 | 0.0393 | 2.95E-09 | 2.47E+06 | 7.28E-03 | 2954 |
| H1.45 | L1 | S52Y (50) | WT | 34501 | 0.0428 | 1.01E-09 | 4.66E+06 | 4.69E-03 | 1006 |
| H1.46 | L1 | F53I (51) | WT | 34502 | 0.0496 | 3.20E-09 | 2.02E+06 | 6.46E-03 | 3196 |
| H1.47 | L1 | F53V (51) | WT | 34503 | 0.0492 | 6.77E-10 | 4.94E+06 | 3.35E-03 | 677 |
| H1.48 | L1 | Y54D (52) | WT | 34504 | 0.0026 | | | | |
| H1.49 | L1 | Y54H (52) | WT | 34505 | 0.0418 | 3.38E-10 | 4.77E+06 | 1.61E-03 | 338 |
| H1.50 | L1 | Y54K (52) | WT | 34506 | -0.0014 | | | | |
| H1.51 | L1 | Y54N (52) | WT | 34507 | 0.0267 | 3.56E-08 | 4.82E+06 | 1.71E-01 | 35550 |
| H1.52 | L1 | Y54S (52) | WT | 34508 | 0.0172 | | | | |
| H1.53 | L1 | Y55H (53) | WT | 34509 | 0.0388 | 3.66E-10 | 2.98E+06 | 1.09E-03 | 366 |
| H1.54 | L1 | Y55S (53) | WT | 34510 | 0.0361 | 6.66E-10 | 2.21E+06 | 1.47E-03 | 666 |
| H1.55 | L1 | G56S (54) | WT | 34511 | 0.0381 | 3.48E-10 | 7.60E+06 | 2.65E-03 | 348 |
| H1.56 | L1 | E60G (55) | WT | 34512 | 0.0323 | 2.03E-10 | 1.38E+07 | 2.78E-03 | 203 |
| H1.57 | L1 | E60S (55) | WT | 34513 | 0.1834 | 7.71E-09 | 1.46E+05 | 1.13E-03 | 7714 |
| H1.58 | L1 | K61D (56) | WT | 34514 | 0.0437 | 2.49E-09 | 1.81E+06 | 4.51E-03 | 2490 |
| H1.59 | L1 | K61N (56) | WT | 34515 | 0.0442 | 5.07E-10 | 2.78E+06 | 1.41E-03 | 507 |
| H1.60 | L1 | K61S (56) | WT | 34516 | 0.0757 | 3.86E-09 | 5.67E+05 | 2.18E-03 | 20 |
| H1.61 | L1 | T62I (57) | WT | 34517 | 0.0548 | 7.91E-10 | 1.77E+06 | 1.40E-03 | 4 |
| H1.62 | L1 | Y63F (58) | WT | 34518 | 0.0596 | 1.35E-09 | 1.03E+06 | 1.38E-03 | 7 |
| H1.63 | L1 | Y63H (58) | WT | 34519 | 0.0631 | 5.28E-09 | 1.45E+06 | 7.65E-03 | 27 |
| H1.64 | L1 | Y63N (58) | WT | 34520 | 0.063 | 5.37E-09 | 1.30E+06 | 6.99E-03 | 28 |
| H1.65 | L1 | Y63S (58) | WT | 34521 | 0.0412 | 1.51E-08 | 3.47E+06 | 5.25E-02 | 78 |
| H1.66 | L1 | N65A (60) | WT | 34522 | 0.057 | 6.23E-10 | 1.81E+06 | 1.13E-03 | 3 |
| H1.67 | L1 | N65S (60) | WT | 34523 | 0.052 | 1.95E-09 | 1.22E+06 | 2.38E-03 | 10 |
| H1.68 | L1 | K69E (64) | WT | 34524 | 0.0535 | 1.50E-09 | 1.75E+06 | 2.63E-03 | 8 |
| H1.69 | L1 | K69Q (64) | WT | 34525 | 0.0634 | 1.41E-09 | 1.41E+06 | 1.98E-03 | 7 |
| H1.70 | L1 | S70G (65) | WT | 34526 | 0.0551 | 7.89E-10 | 1.74E+06 | 1.37E-03 | 4 |
| H1.71 | L1 | A72F (67) | WT | 34527 | 0.0505 | 5.88E-10 | 2.00E+06 | 1.17E-03 | 3 |
| H1.72 | L1 | A72V (67) | WT | 34528 | 0.0566 | 4.20E-10 | 2.33E+06 | 9.79E-04 | 2 |
| H1.73 | L1 | I76V (71) | WT | 34529 | 0.0552 | 7.13E-10 | 2.85E+06 | 2.03E-03 | 4 |
| H1.74 | L1 | S81N (76) | WT | 34530 | 0.0695 | 7.71E-10 | 2.01E+06 | 1.55E-03 | 4 |
| H1.75 | L1 | K86Q (81) | WT | 34531 | 0.0693 | 1.18E-09 | 1.16E+06 | 1.36E-03 | 6 |
| H1.76 | L1 | A93E (85) | WT | 34532 | 0.0648 | 8.29E-10 | 1.49E+06 | 1.24E-03 | 4 |

Figure 44C

| | | VH Variants | VL Variants | Fab XENP | Response | $K_D$ (M) | $k_a$ (1/Ms) | $k_d$ (1/s) | Fold Change $K_D$ |
|---|---|---|---|---|---|---|---|---|---|
| H1.77 | L1 | A93V (85) | WT | 34533 | 0.0609 | 7.49E-10 | 2.34E+06 | 1.75E-03 | 4 |
| H1.78 | L1 | P101A (93) | WT | 34534 | 0.0488 | 6.99E-10 | 2.74E+06 | 1.91E-03 | 4 |
| H1.79 | L1 | T108A (97) | WT | 34535 | 0.0031 | | | | |
| H1.80 | L1 | T108D (97) | WT | 34536 | -0.0149 | | | | |
| H1.81 | L1 | T108N (97) | WT | 34537 | 0.0396 | 3.00E-07 | 3.62E+05 | 1.09E-01 | 1554 |
| H1.82 | L1 | T108S (97) | WT | 34538 | 0.0451 | 2.41E-09 | 1.48E+06 | 3.56E-03 | 12 |
| H1.83 | L1 | M109A (98) | WT | 34539 | 0.0466 | 3.47E-09 | 9.55E+05 | 3.31E-03 | 18 |
| H1.84 | L1 | M109E (98) | WT | 34540 | 0.0584 | 4.16E-09 | 7.62E+05 | 3.17E-03 | 22 |
| H1.85 | L1 | M109S (98) | WT | 34541 | 0.0476 | 4.00E-09 | 9.50E+05 | 3.80E-03 | 21 |
| H1.86 | L1 | M109T (98) | WT | 34542 | 0.0191 | 6.62E-11 | 4.09E+06 | 2.70E-04 | 0 |
| H1.87 | L1 | M109Q (98) | WT | 34543 | 0.0383 | 1.58E-09 | 2.03E+06 | 3.20E-03 | 8 |
| H1.88 | L1 | I110A (99) | WT | 34544 | 0.0234 | 4.02E-10 | 3.63E+06 | 1.46E-03 | 2 |
| H1.89 | L1 | I110D (99) | WT | 34545 | 0.0437 | 1.41E-10 | 1.23E+06 | 1.73E-04 | 1 |
| H1.90 | L1 | I110N (99) | WT | 34546 | 0.0326 | 7.47E-11 | 1.76E+06 | 1.31E-04 | 0 |
| H1.91 | L1 | I110V (99) | WT | 34547 | 0.0371 | 5.12E-10 | 2.98E+06 | 1.53E-03 | 3 |
| H1.92 | L1 | R111A (100) | WT | 34548 | -0.0025 | | | | |
| H1.93 | L1 | R111H (100) | WT | 34549 | -0.0322 | | | | |
| H1.94 | L1 | R111E (100) | WT | 34550 | -0.0251 | | | | |
| H1.95 | L1 | R111K (100) | WT | 34551 | 0.0348 | 2.34E-09 | 2.44E+06 | 5.70E-03 | 12 |
| H1.96 | L1 | R111Q (100) | WT | 34552 | 0.0082 | | | | |
| H1.97 | L1 | R111S (100) | WT | 34553 | -0.0048 | | | | |
| H1.98 | L1 | V113A (100b) | WT | 34554 | 0.0481 | 7.61E-10 | 2.04E+06 | 1.55E-03 | 4 |
| H1.99 | L1 | V113S (100b) | WT | 34555 | 0.0402 | 4.31E-10 | 2.17E+06 | 9.35E-04 | 2 |
| H1.100 | L1 | I114F (100c) | WT | 34556 | 0.0226 | 8.98E-10 | 5.58E+06 | 5.01E-03 | 5 |
| H1.101 | L1 | I114M (100c) | WT | 34557 | 0.0385 | 4.92E-10 | 4.40E+06 | 2.17E-03 | 3 |
| H1.102 | L1 | S116H (102) | WT | 34558 | 0.0302 | 1.39E-10 | 5.30E+06 | 7.35E-04 | 1 |
| H1.103 | L1 | S116L (102) | WT | 34559 | 0.0437 | 1.60E-10 | 2.16E+06 | 3.46E-04 | 1 |
| H1.104 | L1 | S116V (102) | WT | 34560 | 0.0454 | 6.01E-10 | 1.57E+06 | 9.40E-04 | 3 |
| H1.105 | L1 | S116Y (102) | WT | 34561 | 0.0435 | 4.55E-10 | 3.24E+06 | 1.47E-03 | 2 |
| H1.106 | L1 | L122M (108) | WT | 34562 | 0.0553 | 6.24E-10 | 2.09E+06 | 1.31E-03 | 3 |
| H1.107 | L1 | L122T (108) | WT | 34563 | 0.0216 | 1.09E-10 | 6.72E+06 | 7.35E-04 | 1 |
| H1 | L1.1 | WT | L4M (4) | 34564 | 0.029 | 5.69E-10 | 6.48E+06 | 3.69E-03 | 3 |
| H1 | L1.2 | WT | A9G (9) | 34565 | 0.0345 | 3.61E-10 | 4.02E+06 | 1.45E-03 | 2 |
| H1 | L1.3 | WT | A9P (9) | 34566 | 0.0407 | 5.47E-10 | 2.91E+06 | 1.59E-03 | 3 |
| H1 | L1.4 | WT | L13V (13) | 34567 | 0.0347 | 6.01E-10 | 3.74E+06 | 2.25E-03 | 3 |
| H1 | L1.5 | WT | A19V (19) | 34568 | 0.0647 | 1.30E-09 | 1.31E+06 | 1.71E-03 | 7 |
| H1 | L1.6 | WT | R24G (24) | 34569 | 0.0587 | 2.24E-09 | 1.24E+06 | 2.76E-03 | 12 |
| H1 | L1.7 | WT | S28G (28) | 34570 | 0.0339 | 3.15E-10 | 3.73E+06 | 1.17E-03 | 2 |

Figure 44D

| | | VH Variants | VL Variants | Fab XENP | Response | $K_D$ (M) | $k_a$ (1/Ms) | $k_d$ (1/s) | Fold Change $K_D$ |
|---|---|---|---|---|---|---|---|---|---|
| H1 | L1.8 | WT | R30K (30) | 34571 | 0.041 | 1.11E-09 | 1.85E+06 | 2.06E-03 | 6 |
| H1 | L1.9 | WT | R30Q (30) | 34572 | 0.0431 | 1.64E-08 | 1.09E+06 | 1.78E-02 | 85 |
| H1 | L1.10 | WT | R30S (30) | 34573 | 0.0447 | 1.07E-08 | 1.44E+06 | 1.54E-02 | 55 |
| H1 | L1.11 | WT | S37N (31) | 34574 | 0.0426 | 5.97E-10 | 2.06E+06 | 1.23E-03 | 3 |
| H1 | L1.12 | WT | S37T (31) | 34575 | 0.0421 | 5.39E-10 | 2.20E+06 | 1.19E-03 | 3 |
| H1 | L1.13 | WT | Y38H (32) | 34576 | 0.0533 | 1.19E-09 | 1.67E+06 | 1.98E-03 | 6 |
| H1 | L1.14 | WT | Y38N (32) | 34577 | 0.0448 | 1.26E-09 | 2.56E+06 | 3.23E-03 | 7 |
| H1 | L1.15 | WT | A40N (34) | 34578 | 0.0721 | 2.48E-09 | 1.13E+06 | 2.81E-03 | 13 |
| H1 | L1.16 | WT | A40S (34) | 34579 | 0.0469 | 4.64E-10 | 1.59E+06 | 7.37E-04 | 2 |
| H1 | L1.17 | WT | A40T (34) | 34580 | 0.0507 | 6.22E-10 | 1.91E+06 | 1.19E-03 | 3 |
| H1 | L1.18 | WT | Q48K (42) | 34581 | 0.0561 | 8.31E-10 | 1.38E+06 | 1.15E-03 | 4 |
| H1 | L1.19 | WT | Q48L (42) | 34582 | 0.0553 | 9.05E-10 | 1.97E+06 | 1.78E-03 | 5 |
| H1 | L1.20 | WT | D56E (50) | 34583 | 0.0553 | 2.24E-09 | 1.52E+06 | 3.41E-03 | 12 |
| H1 | L1.21 | WT | D56G (50) | 34584 | 0.048 | 4.29E-10 | 2.10E+06 | 8.98E-04 | 2 |
| H1 | L1.22 | WT | D56S (50) | 34585 | 0.0501 | 7.82E-10 | 2.09E+06 | 1.63E-03 | 4 |
| H1 | L1.23 | WT | N59D (53) | 34586 | 0.0559 | 4.79E-10 | 1.41E+06 | 6.72E-04 | 2 |
| H1 | L1.24 | WT | N59S (53) | 34587 | 0.0659 | 6.44E-10 | 1.44E+06 | 9.26E-04 | 3 |
| H1 | L1.25 | WT | N59T (53) | 34588 | 0.0602 | 9.21E-10 | 1.66E+06 | 1.53E-03 | 5 |
| H1 | L1.26 | WT | T62S (56) | 34589 | 0.0651 | 9.90E-10 | 1.61E+06 | 1.60E-03 | 5 |
| H1 | L1.27 | WT | G63S (57) | 34590 | 0.0631 | 9.20E-10 | 1.32E+06 | 1.22E-03 | 5 |
| H1 | L1.28 | WT | I64V (58) | 34591 | 0.0491 | 8.91E-10 | 2.84E+06 | 2.53E-03 | 5 |
| H1 | L1.29 | WT | A66D (60) | 34592 | 0.0459 | 5.89E-10 | 2.16E+06 | 1.27E-03 | 3 |
| H1 | L1.30 | WT | D76E (70) | 34593 | 0.0429 | 6.68E-10 | 2.65E+06 | 1.77E-03 | 3 |
| H1 | L1.31 | WT | S83R (77) | 34594 | 0.0549 | 7.06E-10 | 1.68E+06 | 1.19E-03 | 4 |
| H1 | L1.32 | WT | E85Q (79) | 34595 | 0.0484 | 1.00E-09 | 1.99E+06 | 1.99E-03 | 5 |
| H1 | L1.33 | WT | P86S (80) | 34596 | 0.0519 | 8.73E-10 | 2.16E+06 | 1.88E-03 | 5 |
| H1 | L1.34 | WT | E85Q/P86S (79/80) | 34597 | 0.0795 | 1.61E-09 | 7.44E+05 | 1.20E-03 | 8 |
| H1 | L1.35 | WT | V91T (85) | 34598 | 0.0254 | 3.44E-10 | 3.76E+06 | 1.29E-03 | 2 |
| H1 | L1.36 | WT | R97E (91) | 34599 | 0.0202 | 5.93E-08 | 6.38E+05 | 3.78E-02 | 307 |
| H1 | L1.37 | WT | R97K (91) | 34600 | 0.027 | 2.87E-09 | 1.90E+06 | 5.45E-03 | 15 |
| H1 | L1.38 | WT | R97S (91) | 34601 | 0.0357 | 2.45E-08 | 9.93E+05 | 2.43E-02 | 127 |
| H1 | L1.39 | WT | R97Q (91) | 34602 | 0.0345 | 2.10E-08 | 5.61E+05 | 1.18E-02 | 109 |
| H1 | L1.40 | WT | R97Y (91) | 34603 | 0.0348 | 2.31E-08 | 1.10E+06 | 2.53E-02 | 120 |
| H1 | L1.41 | WT | S98A (92) | 34604 | 0.047 | 2.49E-09 | 1.31E+06 | 3.26E-03 | 13 |
| H1 | L1.42 | WT | S98G (92) | 34605 | 0.0309 | 2.94E-09 | 4.67E+06 | 1.37E-02 | 15 |
| H1 | L1.43 | WT | S98N (92) | 34606 | 0.0342 | 1.08E-09 | 3.32E+06 | 3.59E-03 | 6 |
| H1 | L1.44 | WT | S98T (92) | 34607 | 0.041 | 2.03E-09 | 2.50E+06 | 5.08E-03 | 11 |

Figure 44E

| | | VH Variants | VL Variants | Fab XENP | Response | $K_D$ (M) | $k_a$ (1/Ms) | $k_d$ (1/s) | Fold Change $K_D$ |
|---|---|---|---|---|---|---|---|---|---|
| H1 | L1.45 | WT | N99D (93) | 34608 | 0.0365 | 6.04E-10 | 2.29E+06 | 1.38E-03 | 3 |
| H1 | L1.46 | WT | N99S (93) | 34609 | 0.0379 | 6.66E-10 | 2.28E+06 | 1.52E-03 | 3 |
| H1 | L1.47 | WT | N99Q (93) | 34610 | 0.0377 | 2.96E-10 | 2.28E+06 | 6.76E-04 | 2 |
| H1 | L1.48 | WT | W100H (94) | 34611 | 0.0062 | | | | |
| H1 | L1.49 | WT | W100V (94) | 34612 | -0.0024 | | | | |
| H1 | L1.50 | WT | W100I (94) | 34613 | -0.0042 | | | | |
| H1 | L1.51 | WT | W100L (94) | 34614 | 0.0055 | | | | |
| H1 | L1.52 | WT | W100S (94) | 34615 | 0.0084 | | | | |
| H1 | L1.53 | WT | W100Y (94) | 34616 | 0.0479 | 5.96E-10 | 2.17E+06 | 1.30E-03 | 3 |
| H1 | L1.54 | WT | P104F (96) | 34617 | -0.0021 | | | | |
| H1 | L1.55 | WT | P104I (96) | 34618 | 0.0422 | 3.80E-08 | 1.39E+06 | 5.27E-02 | 197 |
| H1 | L1.56 | WT | P104L (96) | 34619 | 0.0155 | 1.00E-12 | 6.96E+95 | 8.20E-01 | 0 |
| H1 | L1.57 | WT | P104W (96) | 34620 | -0.0035 | | | | |
| H1 | L1.58 | WT | P104Y (96) | 34621 | 0.002 | | | | |
| H1 | L1.59 | WT | Q108G (100) | 34622 | 0.039 | 3.11E-10 | 3.16E+06 | 9.82E-04 | 2 |
| H1 | L1.60 | WT | Q108P (100) | 34623 | 0.0507 | 8.88E-10 | 1.98E+06 | 1.75E-03 | 5 |
| H1 | L1.61 | WT | V112L (104) | 34624 | 0.0521 | 6.42E-10 | 2.12E+06 | 1.36E-03 | 3 |

Figure 45

| Binding to Human TGFßRII | | VH Variants | VL Variants | XENP | Response | $K_D$ (M) | $k_a$ (1/Ms) | $k_d$ (1/s) | Fold Weaker $K_D$ |
|---|---|---|---|---|---|---|---|---|---|
| H1 | L1 | WT | WT | 34287 | 0.1318 | 1.12E-10 | 1.90E+06 | 2.13E-04 | 1 |
| H1.1 | L1 | M109V (98) | WT | 34288 | 0.1325 | 3.52E-10 | 2.19E+06 | 7.69E-04 | 3 |
| H1.21 | L1 | Y33A (33) | WT | 35103 | 0.1211 | 3.74E-10 | 1.43E+06 | 5.34E-04 | 3 |
| H1.29 | L1 | S35T (35) | WT | 35104 | 0.1135 | 1.03E-09 | 1.58E+06 | 1.63E-03 | 9 |
| H1.30 | L1 | S35Y (35) | WT | 35105 | 0.1008 | 1.94E-09 | 1.94E+06 | 3.76E-03 | 17 |
| H1.33 | L1 | G37A (35b) | WT | 35106 | 0.1132 | 1.81E-10 | 1.31E+06 | 2.36E-04 | 2 |
| H1.36 | L1 | G37S (35b) | WT | 35107 | 0.0974 | 1.26E-09 | 9.06E+05 | 1.14E-03 | 11 |
| H1.37 | L1 | I39V (37) | WT | 35108 | 0.1197 | 1.75E-10 | 2.11E+06 | 3.71E-04 | 2 |
| H1.48 | L1 | Y54D (52) | WT | 35111 | 0.0088 | | | | |
| H1.50 | L1 | Y54K (52) | WT | 35112 | 0.0213 | | | | |
| H1.51 | L1 | Y54N (52) | WT | 35109 | 0.046 | 2.63E-8* | 8.48E+06* | 2.23E-1* | 235 |
| H1.56 | L1 | E60G (55) | WT | 35110 | 0.1208 | 1.18E-10 | 2.83E+06 | 3.34E-04 | 1 |

Figure 46

| Binding to Cyno TGFßRII | | VH Variants | VL Variants | XENP | Response | $K_D$ (M) | $k_a$ (1/Ms) | $k_d$ (1/s) | Fold Weaker $K_D$ |
|---|---|---|---|---|---|---|---|---|---|
| H1 | L1 | WT | WT | 34287 | 1.4244 | 6.03E-10 | 4.10E+05 | 2.47E-04 | |
| H1.1 | L1 | M109V (98) | WT | 34288 | 1.9672 | 1.74E-09 | 2.90E+05 | 5.06E-04 | 3 |
| H1.21 | L1 | Y33A (33) | WT | 35103 | 1.3083 | 1.39E-09 | 3.92E+05 | 5.44E-04 | 2 |
| H1.29 | L1 | S35T (35) | WT | 35104 | 1.7793 | 4.27E-09 | 2.46E+05 | 1.05E-03 | 7 |
| H1.30 | L1 | S35Y (35) | WT | 35105 | 1.9042 | 1.33E-08 | 2.53E+05 | 3.37E-03 | 22 |
| H1.33 | L1 | G37A (35b) | WT | 35106 | 2.2239 | 1.17E-09 | 1.91E+05 | 2.24E-04 | 2 |
| H1.36 | L1 | G37S (35b) | WT | 35107 | 2.472 | 3.66E-09 | 1.65E+05 | 6.02E-04 | 6 |
| H1.37 | L1 | I39V (37) | WT | 35108 | 2.6457 | 7.10E-10 | 1.80E+05 | 1.28E-04 | 1 |
| H1.48 | L1 | Y54D (52) | WT | 35111 | 0.177 | 3.94E-07 | 4.47E+05 | 1.76E-01 | 653 |
| H1.50 | L1 | Y54K (52) | WT | 35112 | 0.6586 | 2.21E-07 | 3.21E+05 | 7.08E-02 | 367 |
| H1.51 | L1 | Y54N (52) | WT | 35109 | 1.6088 | 6.14E-08 | 2.48E+05 | 1.52E-02 | 102 |
| H1.56 | L1 | E60G (55) | WT | 35110 | 2.4719 | 1.08E-09 | 2.02E+05 | 2.17E-04 | 2 |

Figure 47

| Binding to Human TGFßRII | | VH Variants | VL Variants | XENP | Response | $K_D$ (M) | $k_a$ (1/Ms) | $k_d$ (1/s) | Fold Weaker $K_D$ |
|---|---|---|---|---|---|---|---|---|---|
| H1 | L1 | WT | WT | 34305 | 0.185 | 2.92E-09 | 9.42E+05 | 2.75E-03 | |
| H1.1 | L1 | M109V (98) | WT | 34306 | 0.1956 | 4.02E-09 | 8.82E+05 | 3.55E-03 | 1 |
| H1.21 | L1 | Y33A (33) | WT | 35119 | 0.1738 | 2.79E-09 | 7.49E+05 | 2.09E-03 | 1 |
| H1.29 | L1 | S35T (35) | WT | 35120 | 0.1834 | 4.60E-09 | 9.45E+05 | 4.35E-03 | 2 |
| H1.30 | L1 | S35Y (35) | WT | 35121 | 0.1741 | 1.03E-08 | 7.90E+05 | 8.12E-03 | 4 |
| H1.33 | L1 | G37A (35b) | WT | 35122 | 0.1814 | 3.42E-09 | 7.88E+05 | 2.70E-03 | 1 |
| H1.36 | L1 | G37S (35b) | WT | 35123 | 0.1961 | 5.10E-09 | 6.25E+05 | 3.19E-03 | 2 |
| H1.37 | L1 | I39V (37) | WT | 35124 | 0.1831 | 2.63E-09 | 8.90E+05 | 2.34E-03 | 1 |
| H1.48 | L1 | Y54D (52) | WT | 35127 | 0.0957 | 3.50E-08 | 5.25E+05 | 1.84E-02 | 12 |
| H1.50 | L1 | Y54K (52) | WT | 35128 | 0.1141 | 3.14E-08 | 7.62E+05 | 2.39E-02 | 11 |
| H1.51 | L1 | Y54N (52) | WT | 35125 | 0.158 | 2.30E-08 | 8.71E+05 | 2.00E-02 | 8 |
| H1.56 | L1 | E60G (55) | WT | 35126 | 0.2179 | 3.36E-09 | 1.15E+06 | 3.85E-03 | 1 |

Figure 48

| Binding to Cyno TGFßRII | | VH Variants | VL Variants | XENP | Response | $K_D$ (M) | $k_a$ (1/Ms) | $k_d$ (1/s) | Fold Weaker $K_D$ |
|---|---|---|---|---|---|---|---|---|---|
| H1 | L1 | WT | WT | 34305 | 2.2729 | 7.06E-10 | 2.35E+05 | 1.66E-04 | 1 |
| H1.1 | L1 | M109V (98) | WT | 34306 | 2.4347 | 1.92E-09 | 2.00E+05 | 3.85E-04 | 3 |

Figure 49A

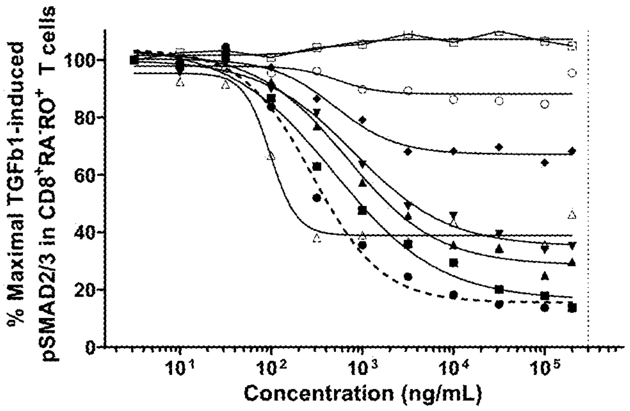

- XENP34287 aPD1 (mAb C) x aTGFßRII (TBRII-A_H1L1) [EC50 = 284.8]
- XENP34288 aPD1 (mAb C) x aTGFßRII (TBRII-A_H1.1_L1) [EC50 = 490.0]
- XENP35104 aPD1 (mAb C) x aTGFßRII (TBRII-A_H1.29(S35T)_L1) [EC50 = 676.8] ($K_D$ - 1nM)
- XENP35107 aPD1 (mAb C) x aTGFßRII (TBRII-A_H1.36(G37S)_L1) [EC50 = 822.5] ($K_D$ - 1.3nM)
- XENP35105 aPD1 (mAb C) x aTGFßRII (TBRII-A_H1.30(S35Y)_L1) [EC50 = 498.9] ($K_D$ - 2-6nM)
- XENP35109 aPD1 (mAb C) x aTGFßRII (TBRII-A_H1.51(Y54N)_L1) [EC50 = 531.9] ($K_D$ - 20nM)
- XENP35111 aPD1 (mAb C) x aTGFßRII (TBRII-A_H1.48(Y54D)_L1)
- XENP35110 aPD1 (mAb C) x aTGFßRII (TBRII-A_H1.56(E60G)_L1) [EC50 = 97.74]

Figure 49B

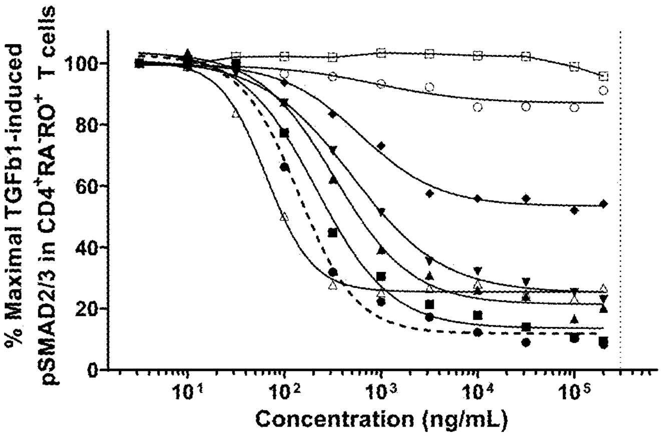

- XENP34287 aPD1 (mAb C) x aTGFßRII (TBRII-A_H1L1) [EC50 = 141]
- XENP34288 aPD1 (mAb C) x aTGFßRII (TBRII-A_H1.1_L1) [EC50 = 215.3]
- XENP35104 aPD1 (mAb C) x aTGFßRII (TBRII-A_H1.29(S35T)_L1) [EC50 = 332.8]
- XENP35107 aPD1 (mAb C) x aTGFßRII (TBRII-A_H1.36(G37S)_L1) [EC50 = 502.9]
- XENP35105 aPD1 (mAb C) x aTGFßRII (TBRII-A_H1.30(S35Y)_L1) [EC50 = 609.6]
- XENP35109 aPD1 (mAb C) x aTGFßRII (TBRII-A_H1.51(Y54N)_L1) [EC50 = 893.1]
- XENP35111 aPD1 (mAb C) x aTGFßRII (TBRII-A_H1.48(Y54D)_L1)
- XENP35110 aPD1 (mAb C) x aTGFßRII (TBRII-A_H1.56(E60G)_L1) [EC50 = 65.24]

Figure 51

| PD1 XENP | HC | LC | KD (M) | kon(1/Ms) | kdis(1/s) |
|---|---|---|---|---|---|
| XENP34288 | H1.1 | L1 | 4.26E-09 | 197500 | 0.0008411 |
| XENP35104 | H1.29 | L1 | 2.431E-09 | 141900 | 0.0003451 |
| XENP35105 | H1.30 | L1 | 1.539E-08 | 207600 | 0.003197 |
| XENP35107 | H1.36 | L1 | 2.889E-09 | 137300 | 0.0003968 |
| XENP36164 | H1.181 | L1 | 2.294E-09 | 219800 | 0.0005041 |
| XENP36166 | H1.183 | L1 | 6.154E-09 | 234200 | 0.001441 |
| XENP36167 | H1.184 | L1 | 4.342E-09 | 161000 | 0.0006989 |
| XENP36168 | H1.185 | L1 | 7.257E-09 | 151200 | 0.001097 |
| XENP36169 | H1.186 | L1 | 1.006E-08 | 143900 | 0.001447 |
| XENP36170 | H1.187 | L1 | 9.081E-09 | 150500 | 0.001367 |
| XENP36171 | H1.188 | L1 | 4.187E-09 | 130300 | 0.0005456 |
| XENP36172 | H1.189 | L1 | 6.989E-09 | 130600 | 0.0009124 |
| XENP36173 | H1.190 | L1 | 9.241E-09 | 131000 | 0.001211 |
| XENP36174 | H1.191 | L1 | 8.43E-09 | 125600 | 0.001059 |
| XENP36175 | H1.192 | L1 | 4.383E-09 | 113500 | 0.0004974 |
| XENP36176 | H1.193 | L1 | 7.146E-09 | 142300 | 0.001017 |
| XENP36177 | H1.194 | L1 | 9.774E-09 | 142300 | 0.00139 |
| XENP36178 | H1.195 | L1 | 8.42E-09 | 147100 | 0.001239 |
| XENP36179 | H1.196 | L1 | 3.69E-09 | 129900 | 0.0004793 |
| XENP36180 | H1.197 | L1 | 6.067E-09 | 127100 | 0.000771 |
| XENP36181 | H1.198 | L1 | 8.405E-09 | 127100 | 0.001068 |
| XENP36182 | H1.199 | L1 | 7.429E-09 | 127500 | 0.0009468 |
| XENP36183 | H1.200 | L1 | 3.024E-09 | 118300 | 0.0003576 |
| XENP36184 | H1.201 | L1 | 5.269E-09 | 121000 | 0.0006376 |
| XENP36185 | H1.202 | L1 | 7.404E-09 | 122100 | 0.0009037 |
| XENP36186 | H1.203 | L1 | 6.435E-09 | 126800 | 0.0008157 |

Figure 52

| XENP | scFv Description | Human KD (nM) | Cyno KD (nM) |
|---|---|---|---|
| | TBRII-A_H1.1_L1 | 2.1 | 1.7 |
| | TBRII-A_H1.29_L1 | 4.2 | 4.3 |
| | TBRII-A_H1.36_L1 | 3.5 | 3.7 |
| | TBRII-A_H1.30_L1 | 14 | 13 |
| | TBRII-A_H1.51_L1 | 53 | 61 |
| XENP37813 | TBRII-A_H1.270_L1 | 31.6 | 56.3 |
| XENP37814 | TBRII-A_H1.189_L1.53 | 58.9 | 108 |
| XENP37815 | TBRII-A_H1.271_L1.53 | 411 | 546 |
| XENP37816 | TBRII-A_H1.270_L1.53 | *ND* | |
| XENP37817 | TBRII-A_H1.272_L1 | 58.2 | 116 |
| XENP37818 | TBRII-A_H1.190_L1.53 | 109 | 202 |
| XENP37819 | TBRII-A_H1.273_L1.53 | 7.7 | 24 |
| XENP37820 | TBRII-A_H1.272_L1.53 | *ND* | |
| XENP37821 | TBRII-A_H1.274_L1 | 16.8 | 40 |
| XENP37822 | TBRII-A_H1.201_L1.53 | 46.6 | 101 |

Figure 53

| Sample ID | Description | Human TGFßRII KD (nM) |
|---|---|---|
| XENP35104 | PD1 x TBRII-A_H1.1_L1 | 0.79 |
| XENP34288 | PD1 x TBRII-A_H1.1_L1 | 0.89 |
| XENP36184 | PD1 x TBRII-A_H1.201_L1 | 0.89 |
| XENP36984 | CD5 (5D7) x TBRII-A_H1.201_L1 | 0.95 |
| XENP36981 | RSV x TBRII-A_H1.201_L1 | 0.96 |
| XENP35399 | CD5 (5D7) x TBRII-A_H1.1_L1 | 0.97 |
| XENP36979 | RSV x TBRII-A_H1.189_L1 | 1.09 |
| XENP36982 | CD5 (5D7) x TBRII-A_H1.189_L1 | 1.24 |
| XENP36172 | PD1 x TBRII-A_H1.189_L1 | 1.29 |
| XENP35107 | PD1 x TBRII-A_H1.29_L1 | 1.31 |
| XENP37315 | CD5 (5D7) x TBRII-A_H1.205_L1 | 1.34 |
| XENP36980 | RSV x TBRII-A_H1.190_L1 | 1.59 |
| XENP36173 | PD1 x TBRII-A_H1.190_L1 | 1.71 |
| XENP36983 | CD5 (5D7) x TBRII-A_H1.190_L1 | 1.88 |
| XENP37314 | CD5 (5D7) x TBRII-A_H1.204_L1 | 2.13 |
| XENP37318 | CD5 (5D7) x TBRII-A_H1.208_L1 | 2.31 |
| XENP37316 | CD5 (5D7) x TBRII-A_H1.206_L1 | 2.42 |
| XENP37320 | CD5 (5D7) x TBRII-A_H1.210_L1 | 2.62 |
| XENP37322 | CD5 (5D7) x TBRII-A_H1.212_L1 | 3.42 |
| XENP37317 | CD5 (5D7) x TBRII-A_H1.207_L1 | 4.58 |
| XENP35105 | PD1 x TBRII-A_H1.30_L1 | 4.64 |
| XENP37324 | CD5 (5D7) x TBRII-A_H1.214_L1 | 4.81 |
| XENP37319 | CD5 (5D7) x TBRII-A_H1.209_L1 | 4.81 |
| XENP37321 | CD5 (5D7) x TBRII-A_H1.211_L1 | 5.43 |
| XENP36132 | CD5 (5D7) x TBRII-A_H1.30_L1 | 6.10 |
| XENP37323 | CD5 (5D7) x TBRII-A_H1.213_L1 | 8.97 |

Figure 60

Human CD5 sequence (SEQ ID NO: 2133)

>sp|P06127
MPMGSLQPLATLYLLGMLVASCLGRLSWYDPDFQARLTRSNSKCQGQLEVYLKDGWHMVCSQSWGRSSKQWEDPSQA
SKVCQRLNCGVPLSLGPFLVTYTPQSSIICYGQLGSFSNCSHSRNDMCHSLGLTCLEPQKTTPPTTRPPPTTTPEPT
APPRLQLVAQSGGQHCAGVVEFYSGSLGGTISYEAQDKTQDLENFLCNNLQCGSFLKHLPETEAGRAQDPGEPREHQ
PLPIQWKIQNSSCTSLEHCFRKIKPQKSGRVLALLCSGFQPKVQSRLVGGSSICEGTVEVRQGAQWAALCDSSSARS
SLRWEEVCREQQCGSVNSYRVLDAGDPTSRGLFCPHQKLSQCHELWERNSYCKKVFVTCQDPNPAGLAAGTVASIIL
ALVLLVVLLVVCGPLAYKKLVKKFRQKKQRQWIGPTGMNQNMSFHRNHTATVRSHAENPTASHVDNEYSQPPRNSHL
SAYPALEGALHRSSMQPDNSSDSDYDLHGAQRL

Human CD5 sequence, extracellular domain (SEQ ID NO: 2134)

>sp|P06127|25-372
RLSWYDPDFQARLTRSNSKCQGQLEVYLKDGWHMVCSQSWGRSSKQWEDPSQASKVCQRLNCGVPLSLGPFLVTYTP
QSSIICYGQLGSFSNCSHSRNDMCHSLGLTCLEPQKTTPPTTRPPPTTTPEPTAPPRLQLVAQSGGQHCAGVVEFYS
GSLGGTISYEAQDKTQDLENFLCNNLQCGSFLKHLPETEAGRAQDPGEPREHQPLPIQWKIQNSSCTSLEHCFRKIK
PQKSGRVLALLCSGFQPKVQSRLVGGSSICEGTVEVRQGAQWAALCDSSSARSSLRWEEVCREQQCGSVNSYRVLDA
GDPTSRGLFCPHQKLSQCHELWERNSYCKKVFVTCQDPNP

Macaca fascicularis CD5 sequence (SEQ ID NO: 2135)

>tr|G7PPY7
MPMGSPQPLATLYLLGMLVASCLGRLSWDDPDFQTRLTRSNSRCQGQLEVYIKYGWHMVCSQSWGRSSNQWEDPNQA
SKVCQRLNCGVPLSLGPFLITDRHQSQITCYGRLGSFSNCSHSGRDVCRPLGLTCLEPQTTTPPPTRPPPTTTPEPT
APPRLQLVAQAAGRHCAGVVEFYSGSLGGTISYEAQDKAQDKTQVLENFLCSSLQCGSFLKHLPETEAATAQDPGEL
REHQPLPIQWTIRNSSCTSLEHCFRKIKPRNSGQVLALLCSGFQPKVQSRLVGGSSICEGTVEVRQGAQWAALCDSS
SAKSSLRWEEVCREQQCGSFNSYQALDAGDPTSRGLSCPHQKLSQCHELTERKSYCKKVFVTCQDPNPAGPAAGTVA
SIILALVLLGVLLVVCGPLAYKKLVKKFRQKKQRQWIGPTGMNQNMSFHRNHTATVRSHVENPTASHVDNEYSQPPR
NSRLSAYPALEGALHRSSTQPDNSSDSDYDLHGAQRL

Macaca fascicularis CD5 sequence, extracellular domain (predicted) (SEQ ID NO: 2136)

>tr|G7PPY7|25-376
RLSWDDPDFQTRLTRSNSRCQGQLEVYIKYGWHMVCSQSWGRSSNQWEDPNQASKVCQRLNCGVPLSLGPFLITDRH
QSQITCYGRLGSFSNCSHSGRDVCRPLGLTCLEPQTTTPPPTRPPPTTTPEPTAPPRLQLVAQAAGRHCAGVVEFYS
GSLGGTISYEAQDKAQDKTQVLENFLCSSLQCGSFLKHLPETEAATAQDPGELREHQPLPIQWTIRNSSCTSLEHCF
RKIKPRNSGQVLALLCSGFQPKVQSRLVGGSSICEGTVEVRQGAQWAALCDSSSAKSSLRWEEVCREQQCGSFNSYQ
ALDAGDPTSRGLSCPHQKLSQCHELTERKSYCKKVFVTCQDPNP

Figure 61

5D7[CD5]_H1L1

| | sequence | SEQ ID NO: |
|---|---|---|
| Variable heavy (vh) domain | EVQLVESGGGVVQPGRSLRLSCTFSGFSLSTSGMGVGWIRQAPGKGLEWVAHIWWDDDVYYNPSLKSRLTITKDASTDTVYMELSSLRSEDTAVYYCVRRRATGTGFDYWGQGTLVTVSS | 2137 |
| vhCDR1 | TSGMGVG | 2138 |
| vhCDR2 | HIWWDDDVYYNPSLKS | 2139 |
| vhCDR3 | RRATGTGFDY | 2140 |
| Variable light (vl) domain | NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK | 2141 |
| vlCDR1 | QASQDVGTAVA | 2142 |
| vlCDR2 | WTSTRHT | 2143 |
| vlCDR3 | HQYNSYNT | 2144 |

>XENP35401 5D7[CD5]_H1L1_IgG1_PVA_/S267K
Heavy Chain - 5D7[CD5]_H1L1_IgG1_PVA_/S267K (SEQ ID NO: 2145)
EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK

Light Chain - 5D7[CD5]_H1L1_IgG1_PVA_/S267K (SEQ ID NO: 2146)
NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 62

Cd5-A[CD5]_H0L0

| | sequence | SEQ ID NO: |
|---|---|---|
| **Variable heavy (vh) domain** | EVQLKESGAELVRPGGSVKISCKGSGYTFTNFAIHWVKQSHIKTLEWIGLISTSSGDVSYNQKFKDKATMTVDKSSSTAYMELARLTSEDSAIYYCARHYGANNYFDYWGQGTLVTVSS | 2147 |
| **vhCDR1** | NFAIH | 2148 |
| **vhCDR2** | LISTSSGDVSYNQKFKD | 2149 |
| **vhCDR3** | HYGANNYFDY | 2150 |
| **Variable light (vl) domain** | EIVLTQSPTIMSASPGEQVTMTCRTNSSVSSSYLHWYQQKSGASPKLWIYGTSNLASGVPTRFSGSGSGTSYSLTISSVEAGDAATYFCQQYSGYPLTFGGGTKVEIK | 2151 |
| **vlCDR1** | RTNSSVSSSYLH | 2152 |
| **vlCDR2** | GTSNLAS | 2153 |
| **vlCDR3** | QQYSGYPLT | 2154 |

Cd5-A[CD5]_H1L1 ~ Humanized

| | Sequence | SEQ ID NO: |
|---|---|---|
| **Variable heavy (vh) domain** | QVQLVQSGAEVKKPGASVKVSCKGSGYTFTNFAIHWVRQAPGQTLEWMGLISTSSGDVSYNQKFQGRVTMTVDKSTSTAYMELSSLRSEDTAVYYCARHYGANNYFDYWGQGTLVTVSS | 2155 |
| **vhCDR1** | NFAIH | 2156 |
| **vhCDR2** | LISTSSGDVSYNQKFQG | 2157 |
| **vhCDR3** | HYGANNYFDY | 2158 |
| **Variable light (vl) domain** | EIVLTQSPGTLSLSPGERATLSCRTNSSVSSSYLHWYQQKPGQSPRLLIYGTSNLASGVPTRFSGSGSGTDYTLTISRLEPEDFAVYFCQQYSGYPLTFGGGTKVEIK | 2159 |
| **vlCDR1** | RTNSSVSSSYLH | 2160 |
| **vlCDR2** | GTSNLAS | 2161 |
| **vlCDR3** | QQYSGYPLT | 2162 |

Figure 63A

Cd5-B[CD5]_H0L0 - Murine

| | sequence | SEQ ID NO: |
|---|---|---|
| Variable heavy (vh) domain | QVTLKESGAELVRPGASVKLSCKASGYSFTSYWMNWVKQRPGQGLEWIGMIHPSDSETRLNQKFKDKATLTVDKSSSTAYMQLSSPTSEDSAVYYCARWGDHDDAMDFWGQGTMVTVSS | 2163 |
| vhCDR1 | SYWMN | 2164 |
| vhCDR2 | MIHPSDSETRLNQKFKD | 2165 |
| vhCDR3 | WGDHDDAMDF | 2166 |
| Variable light (vl) domain | DIVLTQSPASLSASVGESVTITCRPSENIYGYFAWYQQRQGKSPQLLVYNAKTLAEGVPSRFSGSGSGTHFSLKINSLQPEDFGTYYCQHHYGTPFTFGPGTKVDIK | 2167 |
| vlCDR1 | RPSENIYGYFA | 2168 |
| vlCDR2 | NAKTLAE | 2169 |
| vlCDR3 | QHHYGTPFT | 2170 |

Cd5-B[CD5]_H1 – Humanized

| | sequence | SEQ ID NO: |
|---|---|---|
| Variable heavy (vh) domain | EVQLVQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS | 2171 |
| vhCDR1 | SYWMN | 2172 |
| vhCDR2 | MIHPSDSETRYNQSFQG | 2173 |
| vhCDR3 | WGDHDDAMDF | 2174 |

Cd5-B[CD5]_L1 – Humanized

| | | |
|---|---|---|
| Variable light (vl) domain | DIVLTQSPSSLSASVGDRVTITCRPSENIYGYFAWYQQKPGKSPKLLVYNAKTLAEGVPSRFSGSGSGTDFTLTISSLQPEDFATYYCQHHYGTPFTFGPGTKVEIK | 2175 |
| vlCDR1 | RPSENIYGYFA | 2176 |
| vlCDR2 | NAKTLAE | 2177 |
| vlCDR3 | QHHYGTPFT | 2178 |

Cd5-B[CD5]_Affinity-Repaired Cd5-B VH – H1.23

| | sequence | SEQ ID NO: |
|---|---|---|
| Variable heavy (vh) domain | EVQLVQSGAEVKKPGESLKISCKASGYSFTSYWMNWVRQMPGKGLEWMGMIYPSDSETRYNQSFQGQVTISVDKSISTAYLQWSSLKASDTAMYYCARWGDHDDAMDFWGQGTMVTVSS | 2179 |
| vhCDR1 | SYWMN | 2180 |
| vhCDR2 | MIYPSDSETRYNQSFQG | 2181 |
| vhCDR3 | WGDHDDAMDF | 2182 |

Figure 63B

Cd5-B[CD5] Affinity-Repaired Cd5-B VH – H1.36

| | Sequence | SEQ ID NO: |
|---|---|---|
| Variable heavy (vh) domain | EVQLVQSGAEVKKPGESLKISCKASGYSFTSYWMNWVRQMPGKGLEWMGMIHPSDSETRYNQKFQGQVTISVDKSISTAYLQWSSLKASDTAMYYCARWGDHDDAMDFWGQGTMVTVSS | 2183 |
| vhCDR1 | SYWMN | 2184 |
| vhCDR2 | MIHPSDSETRYNQKFQG | 2185 |
| vhCDR3 | WGDHDDAMDF | 2186 |

Cd5-B[CD5] Affinity-Repaired Cd5-B VH – H2

| | sequence | SEQ ID NO: |
|---|---|---|
| Variable heavy (vh) domain | QVQLVQSGAEVKKPGASVKVSCKASGYSFTSYWMNWVRQAPGQGLEWMGMIHPSDSETRYNQKFQGRVTMTVDKSTSTAYMELSSLRSEDTAVYYCARWGDHDDAMDFWGQGTMVTVSS | 2187 |
| vhCDR1 | SYWMN | 2188 |
| vhCDR2 | MIHPSDSETRYNQKFQG | 2189 |
| vhCDR3 | WGDHDDAMDF | 2190 |

Cd5-B[CD5] Affinity-Repaired Cd5-B VL – L2

| | Sequence | SEQ ID NO: |
|---|---|---|
| Variable light (vl) domain | DIVLTQSPDSLAVSLGERATINCKPSENIYGYFAWYQQKPGQSPKLLVYNAKTLAEGVPSRFSGSGSGTDFTLTISSLQAEDVAVYYCQHHYGTPFTFGPGTKVEIK | 2191 |
| vlCDR1 | KPSENIYGYFA | 2192 |
| vlCDR2 | NAKTLAE | 2193 |
| vlCDR3 | QHHYGTPFT | 2194 |

Figure 64A

>XENP35399 5D7[CD5]_H1L1_Fab-TBRII-A[TGFßRII]_H1.1_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1L1_Fab_IgG1_pI(-)_Isosteric_A_/PVA_/S267K/L368D/K370S (SEQ ID NO: 2195)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2196)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - 5D7[CD5]_L1 (SEQ ID NO: 2197)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP36132 5D7[CD5]_H1L1_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1L1_Fab_IgG1_pI(-)_Isosteric_A_/PVA_/S267K/L368D/K370S (SEQ ID NO: 2198)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2199)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - 5D7[CD5]_L1 (SEQ ID NO: 2200)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64B

XENP36983 5D7[CD5]_H1L1_Fab-TBRII-A[TGF RII]_H1.190_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1IgG1_pI(-)_Isosteric_A_PVA_/S267K/L368D/K370S (SEQ ID NO: 2201)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.190_L1_scFv(GKPGS)4_Fc(216)_IgG1_C220S/PVA_/S267K/S364K/E357Q (SEQ ID NO: 2202)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2203)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

XENP36984 5D7[CD5]_H1L1_Fab-TBRII-A[TGF RII]_H1.201_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1IgG1_pI(-)_Isosteric_A_PVA_/S267K/L368D/K370S (SEQ ID NO: 2204)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGF RII]_H1.201_L1_scFv(GKPGS)4_Fc(216)_IgG1_C220S/PVA_/S267K/S364K/E357Q (SEQ ID NO: 2205)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2206)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64C

>XENP37314 5D7[CD5]_H1L1_Fab-TBRII-A[TGFßRII]_H1.204_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2207)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.204_L1_scFv(GKPGS)4_Fc(216)_IgG1_C220S/PVA_/S267K/S364K/E357Q (SEQ ID NO: 2208)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTAIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2209)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37315 5D7[CD5]_H1L1_Fab-TBRII-A[TGFßRII]_H1.205_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2210)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.205_L1_scFv(GKPGS)4_Fc(216)_IgG1_C220S/PVA_/S267K/S364K/E357Q (SEQ ID NO: 2211)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTIIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2212)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64D

>XENP37316 5D7[CD5]_H1L1_Fab-TBRII-A[TGFßRII]_H1.206_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2213)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.206_L1_scFv(GKPGS)4_Fc(216)_IgG1_C220S/PVA_/S267K/S364K/E357Q (SEQ ID NO: 2214)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTSIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2215)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37317 5D7[CD5]_H1L1_Fab-TBRII-A[TGFßRII]_H1.207_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2216)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.207_L1_scFv(GKPGS)4_Fc(216)_IgG1_C220S/PVA_/S267K/S364K/E357Q (SEQ ID NO: 2217)

QLQVQESGPGLVKPSETLSLTCTVSGGSISSSYFTWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2218)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64E

>XENP37318 5D7[CD5]_H1L1_Fab-TBRII-A[TGFßRII]_H1.208_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2219)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.208_L1_scFv(GKPGS)4_Fc(216)_IgG1_C220S/PVA_/S267K/S364K/E357Q (SEQ ID NO: 2220)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2221)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37319 5D7[CD5]_H1L1_Fab-TBRII-A[TGFßRII]_H1.209_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2222)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.209_L1_scFv(GKPGS)4_Fc(216)_IgG1_C220S/PVA_/S267K/S364K/E357Q (SEQ ID NO: 2223)

QLQVQESGPGLVKPSETLSLTCTVSGGSISSSYFYWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2224)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64F

>XENP37320 5D7[CD5]_H1L1_Fab-TBRII-A[TGFßRII]_H1.210_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2225)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.210_L1_scFv(GKPGS)4_Fc(216)_IgG1_C220S/PVA_/S267K/S364K/E357Q (SEQ ID NO: 2226)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTLIRGVFDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2227)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37321 5D7[CD5]_H1L1_Fab-TBRII-A[TGFßRII]_H1.211_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2228)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.211_L1_scFv(GKPGS)4_Fc(216)_IgG1_C220S/PVA_/S267K/S364K/E357Q (SEQ ID NO: 2229)

QLQVQESGPGLVKPSETLSLTCTVSGGSISSSYFTWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2230)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64G

>XENP37322 5D7[CD5]_H1L1_Fab-TBRII-A[TGFßRII]_H1.212_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2231)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.212_L1_scFv(GKPGS)4_Fc(216)_IgG1_C220S/PVA_/S267K/S364K/E357Q (SEQ ID NO: 2232)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2233)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37323 5D7[CD5]_H1L1_Fab-TBRII-A[TGFßRII]_H1.213_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2234)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.213_L1_scFv(GKPGS)4_Fc(216)_IgG1_C220S/PVA_/S267K/S364K/E357Q (SEQ ID NO: 2235)

QLQVQESGPGLVKPSETLSLTCTVSGGSISSSYFYWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2236)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64H

>XENP37324 5D7[CD5]_H1L1_Fab-TBRII-A[TGFßRII]_H1.214_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2237)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.214_L1_scFv(GKPGS)4_Fc(216)_IgG1_C220S/PVA_/S267K/S364K/E357Q (SEQ ID NO: 2238)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTTIRGVFDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2239)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37379 5D7[CD5]_H1L1_Fab-TBRII-A[TGFßRII]_H1.51_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_PVA_/S267K/L368D/K370S (SEQ ID NO: 2240)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2241)

QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2242)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64I

>XENP37380 5D7[CD5]_H1L1_Fab-TBRII-A[TGFßRII]_L1_H1.1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_PVA_/S267K/L368D/K370S (SEQ ID NO: 2243)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_L1_H1.1_scFv(GKPGS)4_Fc(216)_IgG1_C220S/PVA_/S267K/S364K/E357Q (SEQ ID NO: 2244)

EIVLTQSPATLSLSPGERATLSCRASQSVRSYLAWYQQKPGQAPRLLIYDASNRATGIPARFSGSGSGTDFTLTISS
LEPEDFAVYYCQQRSNWPPTFGQGTKVEIKGKPGSGKPGSGKPGSGKPGSQLQVQESGPGLVKPSETLSLTCTVSGG
SISNSYFSWGWIRQPPGKGLEWIGSFYYGEKTYYNPSLKSRATISIDTSKSQFSLKLSSVTAADTAVYYCPRGPTVI
RGVIDSWGQGTLVTVSS/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2245)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP37381 5D7[CD5]_H1L1_Fab-TBRII-A[TGFßRII]_H1.34_L1_scFv(GKPGS)4-IgG1_pI(-)_Isosteric_A_PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_PVA_/S267K/L368D/K370S (SEQ ID NO: 2246)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-A[TGFßRII]_H1.34_L1_scFv(GKPGS)4_Fc(216)_IgG1_C220S/PVA_/S267K/S364K/E357Q (SEQ ID NO: 2247)

QLQVQESGPGLVKPSETLSLTCTVSGGSISNSYFSWHWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - 5D7[CD5]_L1 Light Chain (SEQ ID NO: 2248)

NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 64J

>XENP37385 Cd5-A[CD5]_H0L0_Fab-TBRII-A[TGFßRII]_H1.1_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H0L0_Fab_IgG1_pI(-)_Isosteric_A_/PVA_/S267K/L368D/K370S (SEQ ID NO: 2249)

EVQLKESGAELVRPGGSVKISCKGSGYTFTNFAIHWVKQSHIKTLEWIGLISTSSGDVSYNQKFKDKATMTVDKSSS
TAYMELARLTSEDSAIYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2250)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Cd5-A[CD5]_L0 (SEQ ID NO: 2251)

EIVLTQSPTIMSASPGEQVTMTCRTNSSVSSSYLHWYQQKSGASPKLWIYGTSNLASGVPTRFSGSGSGTSYSLTIS
SVEAGDAATYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP37388 Cd5-B[CD5]_H0L0_Fab-TBRII-A[TGFßRII]_H1.1_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H0L0_Fab_IgG1_pI(-)_Isosteric_A_/PVA_/S267K/L368D/K370S (SEQ ID NO: 2252)

QVTLKESGAELVRPGASVKLSCKASGYSFTSYWMNWVKQRPGQGLEWIGMIHPSDSETRLNQKFKDKATLTVDKSSS
TAYMQLSSPTSEDSAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2253)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Cd5-B[CD5]_L0 (SEQ ID NO: 2254)

DIVLTQSPASLSASVGESVTITCRPSENIYGYFAWYQQRQGKSPQLLVYNAKTLAEGVPSRFSGSGSGTHFSLKINS
LQPEDFGTYYCQHHYGTPFTFGPGTKVDIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64K

>XENP37401 Cd5-B[CD5]_H0L0_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H0L0_Fab_IgG1_pI(-)_Isosteric_A_/PVA_/S267K/L368D/K370S (SEQ ID NO: 2255)

QVTLKESGAELVRPGASVKLSCKASGYSFTSYWMNWVKQRPGQGLEWIGMIHPSDSETRLNQKFKDKATLTVDKSSS
TAYMQLSSPTSEDSAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2256)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSS/GKPGSGKPGSGKPGSGKPGS/EIVLTQSPATL
SLSPGERATLSCRASQSVRSYLAWYQQKPGQAPRLLIYDASNRATGIPARFSGSGSGTDFTLTISSLEPEDFAVYYC
QQRSNWPPTFGQGTKVEIK/EPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

Chain 3 - Cd5-B[CD5]_L0 (SEQ ID NO: 2257)

DIVLTQSPASLSASVGESVTITCRPSENIYGYFAWYQQRQGKSPQLLVYNAKTLAEGVPSRFSGSGSGTHFSLKINS
LQPEDFGTYYCQHHYGTPFTFGPGTKVDIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37573 Cd5-A[CD5]_H0L0_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H0_IgG1_pI(-)_Isosteric_A_/PVA_/S267K/L368D/K370S (SEQ ID NO: 2258)

EVQLKESGAELVRPGGSVKISCKGSGYTFTNFAIHWVKQSHIKTLEWIGLISTSSGDVSYNQKFKDKATMTVDKSSS
TAYMELARLTSEDSAIYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2259)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-A[CD5]_L0 Light Chain (SEQ ID NO: 2260)

EIVLTQSPTIMSASPGEQVTMTCRTNSSVSSSYLHWYQQKSGASPKLWIYGTSNLASGVPTRFSGSGSGTSYSLTIS
SVEAGDAATYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

Figure 64L

>XENP37575 Cd5-A[CD5]_H0L0_Fab-TBRII-A[TGFßRII]_H1.51_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H0_IgG1_pI(-)_Isosteric_A_/PVA_/S267K/L368D/K370S (SEQ ID NO: 2261)
EVQLKESGAELVRPGGSVKISCKGSGYTFTNFAIHWVKQSHIKTLEWIGLISTSSGDVSYNQKFKDKATMTVDKSSS
TAYMELARLTSEDSAIYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2262)
QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-A[CD5]_L0 Light Chain (SEQ ID NO: 2263)
EIVLTQSPTIMSASPGEQVTMTCRTNSSVSSSYLHWYQQKSGASPKLWIYGTSNLASGVPTRFSGSGSGTSYSLTIS
SVEAGDAATYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP37576 Cd5-B[CD5]_H0L0_Fab-TBRII-A[TGFßRII]_H1.51_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H0_IgG1_pI(-)_Isosteric_A_/PVA_/S267K/L368D/K370S (SEQ ID NO: 2264)
QVTLKESGAELVRPGASVKLSCKASGYSFTSYWMNWVKQRPGQGLEWIGMIHPSDSETRLNQKFKDKATLTVDKSSS
TAYMQLSSPTSEDSAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2265)
QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L0 Light Chain (SEQ ID NO: 2266)
DIVLTQSPASLSASVGESVTITCRPSENIYGYFAWYQQRQGKSPQLLVYNAKTLAEGVPSRFSGSGSGTHFSLKINS
LQPEDFGTYYCQHHYGTPFTFGPGTKVDIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64M

>XENP37675 Cd5-A[CD5]_H1L1_Fab-TBRII-A[TGFßRII]_H1.1_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H1_IgG1_pI(-)_Isosteric_A_/PVA_/S267K/L368D/K370S (SEQ ID NO: 2267)

QVQLVQSGAEVKKPGASVKVSCKGSGYTFTNFAIHWVRQAPGQTLEWMGLISTSSGDVSYNQKFQGRVTMTVDKSTS
TAYMELSSLRSEDTAVYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2268)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-A[CD5]_L1 Light Chain (SEQ ID NO: 2269)

EIVLTQSPGTLSLSPGERATLSCRTNSSVSSSYLHWYQQKPGQSPRLLIYGTSNLASGVPTRFSGSGSGTDYTLTIS
RLEPEDFAVYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP37676 Cd5-A[CD5]_H1L1_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H1_IgG1_pI(-)_Isosteric_A_/PVA_/S267K/L368D/K370S (SEQ ID NO: 2270)

QVQLVQSGAEVKKPGASVKVSCKGSGYTFTNFAIHWVRQAPGQTLEWMGLISTSSGDVSYNQKFQGRVTMTVDKSTS
TAYMELSSLRSEDTAVYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2271)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-A[CD5]_L1 Light Chain (SEQ ID NO: 2272)

EIVLTQSPGTLSLSPGERATLSCRTNSSVSSSYLHWYQQKPGQSPRLLIYGTSNLASGVPTRFSGSGSGTDYTLTIS
RLEPEDFAVYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

Figure 64N

>XENP37677 Cd5-A[CD5]_H1L1_Fab-TBRII-A[TGFßRII]_H1.51_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-A[CD5]_H1_IgG1_pI(-)_Isosteric_A_/PVA_/S267K/L368D/K370S (SEQ ID NO: 2273)

QVQLVQSGAEVKKPGASVKVSCKGSGYTFTNFAIHWVRQAPGQTLEWMGLISTSSGDVSYNQKFQGRVTMTVDKSTS
TAYMELSSLRSEDTAVYYCARHYGANNYFDYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2274)

QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-A[CD5]_L1 Light Chain (SEQ ID NO: 2275)

EIVLTQSPGTLSLSPGERATLSCRTNSSVSSSYLHWYQQKPGQSPRLLIYGTSNLASGVPTRFSGSGSGTDYTLTIS
RLEPEDFAVYFCQQYSGYPLTFGGGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

>XENP37678 Cd5-B[CD5]_H1L1_Fab-TBRII-A[TGFßRII]_H1.1_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2276)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.1_L1_scFv(GKPGS)4_Fc(216)_IgG1_C220S/PVA_/S267K/S364K/E357Q (SEQ ID NO: 2277)

QLQVQESGPGLVKPSETLSLTCTVSGGSISNSYFSWGWIRQPPGKGLEWIGSFYYGEKTYYNPSLKSRATISIDTSK
SQFSLKLSSVTAADTAVYYCPRGPTVIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2278)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64O

>XENP37679 Cd5-B[CD5]_H1L1_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2279)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2280)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2281)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37680 Cd5-B[CD5]_H1L1_Fab-TBRII-A[TGFßRII]_H1.51_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2282)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.51_L1_scFv(GKPGS)4_Fc(216)_IgG1_C220S/PVA_/S267K/S364K/E357Q (SEQ ID NO: 2283)

QLQVQESGPGLVKPSETLSLTCTVSGGSISNSYFSWGWIRQPPGKGLEWIGSFNYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2284)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64P

>XENP37813 Cd5-B[CD5]_H1L1_Fab-TBRII-A[TGFßRII]_H1.270_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2285)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.270_L1_scFv(GKPGS)4_Fc(216)_IgG1_C220S/PVA_/S267K/S364K/E357Q (SEQ ID NO: 2286)

QLQVQESGPGLVKPSETLSLTCTVSGGSISSSYFSWGWIRQPPGKGLEWIGSFNYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2287)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37814 Cd5-B[CD5]_H1L1_Fab-TBRII-A[TGFßRII]_H1.189_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2288)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.189_L1.53_scFv(GKPGS)4_Fc(216)_IgG1_C220S/PVA_/S267K/S364K/E357Q (SEQ ID NO: 2289)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2290)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64Q

>XENP37815 Cd5-B[CD5]_H1L1_Fab-TBRII-A[TGFßRII]_H1.271_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2291)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.271_L1.53_scFv(GKPGS)4_Fc(216)_IgG1_C220S/PVA_/S267K/S364K/E357Q (SEQ ID NO: 2292)

QLQVQESGPGLVKPSETLSLTCTVSGGSISSSYFSWHWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2293)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37816 Cd5-B[CD5]_H1L1_Fab-TBRII-A[TGFßRII]_H1.270_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2294)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.270_L1.53_scFv(GKPGS)4_Fc(216)_IgG1_C220S/PVA_/S267K/S364K/E357Q (SEQ ID NO: 2295)

QLQVQESGPGLVKPSETLSLTCTVSGGSISSSYFSWGWIRQPPGKGLEWIGSFNYGGKTYYNPSLKSRATISIDTSK
NQFSLKLSSVTAADTAVYYCARGPTLIRGVIDSWGQGTLVTVSSGKPGSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2296)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64R

>XENP37817 Cd5-B[CD5]_H1L1_Fab-TBRII-A[TGFßRII]_H1.272_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2297)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.272_L1_scFv(GKPGS)4_Fc(216)_IgG1_C220S/PVA_/S267K/S364K/E357Q (SEQ ID NO: 2298)

QLQVQESGPGLVKPSETLSLTCTVSGGSISSSYFSWGWIRQPPGKGLEWIGSFNYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2299)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37818 Cd5-B[CD5]_H1L1_Fab-TBRII-A[TGFßRII]_H1.190_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2300)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.190_L1.53_scFv(GKPGS)4_Fc(216)_IgG1_C220S/PVA_/S267K/S364K/E357Q (SEQ ID NO: 2301)

QLQVQESGPGLVKPSETLSLTCTVSGGSISSSYFSWGWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2302)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64S

>XENP37819 Cd5-B[CD5]_H1L1_Fab-TBRII-A[TGFßRII]_H1.273_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2303)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.273_L1.53_scFv(GKPGS)4_Fc(216)_IgG1_C220S/PVA_/S267K/S364K/E357Q (SEQ ID NO: 2304)

QLQVQESGPGLVKPSETLSLTCTVSGGSISSSYFSWHWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2305)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37820 Cd5-B[CD5]_H1L1_Fab-TBRII-A[TGFßRII]_H1.272_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2306)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.272_L1.53_scFv(GKPGS)4_Fc(216)_IgG1_C220S/PVA_/S267K/S364K/E357Q (SEQ ID NO: 2307)

QLQVQESGPGLVKPSETLSLTCTVSGGSISSSYFSWGWIRQPPGKGLEWIGSFNYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2308)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64T

>XENP37821 Cd5-B[CD5]_H1L1_Fab-TBRII-A[TGFßRII]_H1.274_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2309)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.274_L1_scFv(GKPGS)4_Fc(216)_IgG1_C220S/PVA_/S267K/S364K/E357Q (SEQ ID NO: 2310)

QLQVQESGPGLVKPSETLSLTCTVSGGSISNAYFSWGWIRQPPGKGLEWIGSFNYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2311)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP37822 Cd5-B[CD5]_H1L1_Fab-TBRII-A[TGFßRII]_H1.201_L1.53_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2312)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.201_L1.53_scFv(GKPGS)4_Fc(216)_IgG1_C220S/PVA_/S267K/S364K/E357Q (SEQ ID NO: 2313)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNYPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2314)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64U

>XENP38116 Cd5-B[CD5]_H1L0_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1_IgG1_pI(-)_Isosteric_A_/PVA_/S267K/L368D/K370S (SEQ ID NO: 2315)

EVQLVQSGAEVKKPGESLKISCKASGYSFTSYWMNWVRQMPGKGLEWMGMIHPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2316)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L0 Light Chain (SEQ ID NO: 2317)

DIVLTQSPASLSASVGESVTITCRPSENIYGYFAWYQQRQGKSPQLLVYNAKTLAEGVPSRFSGSGSGTHFSLKINS
LQPEDFGTYYCQHHYGTPFTFGPGTKVDIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP38117 Cd5-B[CD5]_H0L1_Fab-TBRII-A[TGFßRII]_H1.30_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H0_IgG1_pI(-)_Isosteric_A_/PVA_/S267K/L368D/K370S (SEQ ID NO: 2318)

QVTLKESGAELVRPGASVKLSCKASGYSFTSYWMNWVKQRPGQGLEWIGMIHPSDSETRLNQKFKDKATLTVDKSSS
TAYMQLSSPTSEDSAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.30_L1_scFv(GKPGS)4_Fc(216)_IgG1_C220S/PVA_/S267K/S364K/E357Q (SEQ ID NO: 2319)

QLQVQESGPGLVKPSETLSLTCTVSGGSISNSYFYWGWIRQPPGKGLEWIGSFYYGEKTYYNPSLKSRATISIDTSK
SQFSLKLSSVTAADTAVYYCPRGPTMIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2320)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64V

>XENP39131 Cd5-B[CD5]_H2L1_Fab-TBRII-A[TGFßRII]_H1.212_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H2_IgG1_pI(-)_Isosteric_A_/PVA_/S267K/L368D/K370S (SEQ ID NO: 2321)

QVQLVQSGAEVKKPGASVKVSCKASGYSFTSYWMNWVRQAPGQGLEWMGMIHPSDSETRYNQKFQGRVTMTVDKSTS
TAYMELSSLRSEDTAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.212_L1_scFv(GKPGS)4_Fc(216)_IgG1_C220S/PVA_/S267K/S364K/E357Q (SEQ ID NO: 2322)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2323)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP39132 Cd5-B[CD5]_H1.23_L1_Fab-TBRII-A[TGFßRII]_H1.212_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1.23__IgG1_pI(-)_Isosteric_A_/PVA_/S267K/L368D/K370S (SEQ ID NO: 2324)

EVQLVQSGAEVKKPGESLKISCKASGYSFTSYWMNWVRQMPGKGLEWMGMIYPSDSETRYNQSFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.212_L1_scFv(GKPGS)4_Fc(216)_IgG1_C220S/PVA_/S267K/S364K/E357Q (SEQ ID NO: 2325)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2326)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 64W

>XENP39133 Cd5-B[CD5]_H1.36_L1_Fab-TBRII-A[TGFßRII]_H1.212_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H1.36__IgG1_pI(-)_Isosteric_A_/PVA_/S267K/L368D/K370S (SEQ ID NO: 2327)

EVQLVQSGAEVKKPGESLKISCKASGYSFTSYWMNWVRQMPGKGLEWMGMIHPSDSETRYNQKFQGQVTISVDKSIS
TAYLQWSSLKASDTAMYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.212_L1_scFv(GKPGS)4_Fc(216)_IgG1_C220S/PVA_/S267K/S364K/E357Q (SEQ ID NO: 2328)

QLQVQESGPGLVKPSETLSLTCTVSGGSISSSYFSWSWIRQPPGKGLEWIGSFYYGGKTYYNPSLKSRATISIDTSK
NQFSLKLSSVTAADTAVYYCARGPTTIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2329)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP40323 Cd5-B[CD5]_H2L1_Fab-TBRII-A[TGFßRII]_H1.201_L1_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - Cd5-B[CD5]_H2_IgG1_pI(-)_Isosteric_A_/PVA_/S267K/L368D/K370S (SEQ ID NO: 2330)

QVQLVQSGAEVKKPGASVKVSCKASGYSFTSYWMNWVRQAPGQGLEWMGMIHPSDSETRYNQKFQGRVTMTVDKSTS
TAYMELSSLRSEDTAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-A[TGFßRII]_H1.201_L1_scFv(GKPGS)4_Fc(216)_IgG1_C220S/PVA_/S267K/S364K/E357Q (SEQ ID NO: 2331)

QLQVQESGPGLVKPSETLSLTCTVSGGSISNAYFSWGWIRQPPGKGLEWIGSFYYGGKTYYNPSLKSRATISIDTSK
NQFSLKLSSVTAADTAVYYCARGPTLIRGVIDSWGQGTLVTVSSGKPGSGKPGSGKPGSGKPGSEIVLTQSPATLSL
SPGERATLSCRASQSVRSYLAWYQQKPGQAPRLLIYDASNRATGIPARFSGSGSGTDFTLTISSLEPEDFAVYYCQQ
RSNWPPTFGQGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Chain 3 - Cd5-B[CD5]_L1 Light Chain (SEQ ID NO: 2332)

DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 65

>XENP38257 5D7[CD5]_H1L1_Fab- TBRII-B[TGFßRII]_H1-IgG1_pI(-)_Isosteric_A_/PVA_/S267K/L368D/K370S-Fc(216)_IgG1_C220S/PVA_/S267K/S364K/E357Q

Chain 1 - 5D7[CD5]_H1_IgG1_pI(-)_Isosteric_A_/PVA_/S267K/L368D/K370S (SEQ ID NO: 2333)
EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSDTKVDKKVEPKSCDKTHTCP
PCPAPPVAGPSVFLFPPKPKDTLMISRTPEVTCVVVDVKHEDPEVKFNWYVDGVEVHNAKTKPREEEYNSTYRVVSV
LTVLHQDWLNGKEYKCKVSNKALPAPIEKTISKAKGQPREPQVYTLPPSREEMTKNQVSLTCDVSGFYPSDIAVEWE
SDGQPENNYKTTPPVLDSDGSFFLYSKLTVDKSRWEQGDVFSCSVMHEALHNHYTQKSLSLSPGK

Chain 2 - TBRII-B[TGFßRII]_H1_Fc(216)_IgG1_C220S/PVA_/S267K/S364K/E357Q (SEQ ID NO: 2334)
EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK

Chain 3 - 5D7[CD5]_L1 Light Chain (SEQ ID NO: 2335)
NIVMTQSPSSLSASVGDRVTITCQASQDVGTAVAWYQQKPDQSPKLLIYWTSTRHTGVPDRFTGSGSGTDFTLTISS
LQPEDIATYFCHQYNSYNTFGSGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP38257 Cd5-B[CD5]_H2L1_Fab- TBRII-B[TGFßRII]_H1-IgG1_pI(-)_Isosteric_A_/PVA_/S267K/L368D/K370S-Fc(216)_IgG1_C220S/PVA_/S267K/S364K/E357Q

Chain 1 – Cd5-B[CD5]_H2_IgG1_pI(-)_Isosteric_A_/PVA_/S267K/L368D/K370S (SEQ ID NO: 2336)
QVQLVQSGAEVKKPGASVKVSCKASGYSFTSYWMNWVRQAPGQGLEWMGMIHPSDSETRYNQKFQGRVTMTVDKSTS
TAYMELSSLRSEDTAVYYCARWGDHDDAMDFWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPP
CPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWES
DGQPENNYKTTPPVLDSDGSFFLYSKLTVDKSRWEQGDVFSCSVMHEALHNHYTQKSLSLSPGK

Chain 2 - TBRII-B[TGFßRII]_H1_Fc(216)_IgG1_C220S/PVA_/S267K/S364K/E357Q (SEQ ID NO: 2334)
EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSD
GSFFLYSKLTVDKSRWQQGNVFSCSVMHEALHNHYTQKSLSLSPGK

Chain 3 – Cd5-B[CD5]_L1 Light Chain (SEQ ID NO: 2337)
DIVLTQSPSSLSASVGDRVTITCRPSENIYGYFAWYQQKPGKSPKLLVYNAKTLAEGVPSRFSGSGSGTDFTLTISS
LQPEDFATYYCQHHYGTPFTFGPGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 66

>XENCXXX TBRII-B[TGFßRII]_H1_VHH-5D7[CD5]H1L1_scFv(GKPGS)4-Fc(216)_IgG1_pI(-)_Isosteric_A_C220S/PVA_/S267K/L368D/K370S-Fc(216)_IgG1_C220S/PVA_/S267K/S364K/E357Q

Chain 1 - TBRII-B[TGFßRII]_H1_VHH_Fc(216)_IgG1_pI(-)_Isosteric_A_C220S/PVA_/S267K/L368D/K370S (SEQ ID NO: 2338)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - 5D7[CD5]H1L1_scFv(GKPGS)4_Fc(216)_IgG1_C220S/PVA_/S267K/S364K/E357Q (SEQ ID NO: 2339)

EVQLVESGGGVVQPGRSLRLSCTFSGFSLSTSGMGVGWIRQAPGKGLEWVAHIWWDDDVYYNPSLKSRLTITKDAST
DTVYMELSSLRSEDTAVYYCVRRRATGTGFDYWGQGTLVTVSS/GKPGSGKPGSGKPGSGKPGS/NIVMTQSPSSLS
ASVGDRVTITCQASQDVGTAVAWYQQKPDQSPKLLIYWTSTRHTGVPDRFTGSGSGTDFTLTISSLQPEDIATYFCH
QYNSYNTFGSGTKLEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

>XENCXXX TBRII-B[TGFßRII]_H1_VHH-Cd5-B[CD5]H2L1_scFv(GKPGS)4-Fc(216)_IgG1_pI(-)_Isosteric_A_C220S/PVA_/S267K/L368D/K370S-Fc(216)_IgG1_C220S/PVA_/S267K/S364K/E357Q

Chain 1 - TBRII-B[TGFßRII]_H1_VHH_Fc(216)_IgG1_pI(-)_Isosteric_A_C220S/PVA_/S267K/L368D/K370S (SEQ ID NO: 2338)

EVQLLESGGGLVQPGGSLRLSCAASGFTFGTEQMWWVRQAPGKGLEFVSRIDSPGGRTYYANSVKGRFTISRDNSKN
TLYLQMNSLRAEDTAVYYCAKRRPTGVSGTFYDYWGQGTLVTVSS/EPKSSDKTHTCPPCPAPPVAGPSVFLFPPKP
KDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 – Cd5-B[CD5]H2L1_scFv(GKPGS)4_Fc(216)_IgG1_C220S/PVA_/S267K/S364K/E357Q (SEQ ID NO: 2340)

QVQLVQSGAEVKKPGASVKVSCKASGYSFTSYWMNWVRQAPGQGLEWMGMIHPSDSETRYNQKFQGRVTMTVDKSTS
TAYMELSSLRSEDTAVYYCARWGDHDDAMDFWGQGTMVTVSS/GKPGSGKPGSGKPGSGKPGS/DIVLTQSPSSLSA
SVGDRVTITCRPSENIYGYFAWYQQKPGKSPKLLVYNAKTLAEGVPSRFSGSGSGTDFTLTISSLQPEDFATYYCQH
HYGTPFTFGPGTKVEIK/EPKSSDKTHTCPPCPAPPVAGPSVFLFPPKPKDTLMISRTPEVTCVVVDVKHEDPEVKF
NWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

Figure 68

| Description | Human KD (nM) | Cyno KD (nM) |
|---|---|---|
| XENP35399 – αCD5 (5D7) x αTGFßRII | 1.69 | 72.0 |
| XENP37385 – αCD5 (Cd5-A) x αTGFßRII | 6.67 | 11.3 |
| αCD5 (Clone 1) x αTGFßRII | 7.91 | 39.8 |
| αCD5 (Clone 2) x αTGFßRII | N.R. | N.R. |
| XENP37388 – αCD5 (Cd5-B) x αTGFßRII | 2.75 | 0.74 |
| αCD5 (Clone 3) x αTGFßRII | 1.53 | L.R. |
| αCD5 (Clone 4) x αTGFßRII | 7.03 | 95.4 |
| αCD5 (Clone 5) x αTGFßRII | 12.90 | 53.6 |
| αCD5 (Clone 6) x αTGFßRII | 11.10 | L.R. |
| αCD5 (Clone 7) x αTGFßRII | 2.05 | 13.2 |
| αCD5 (Clone 8) x αTGFßRII | 8.72 | L.R. |
| αCD5 (Clone 9) x αTGFßRII | 2.99 | 1.00 |
| αCD5 (Clone 10) x αTGFßRII | 1.24 | L.R. |
| αCD5 (Clone 11) x αTGFßRII | 18.60 | L.R. |

Figure 72A

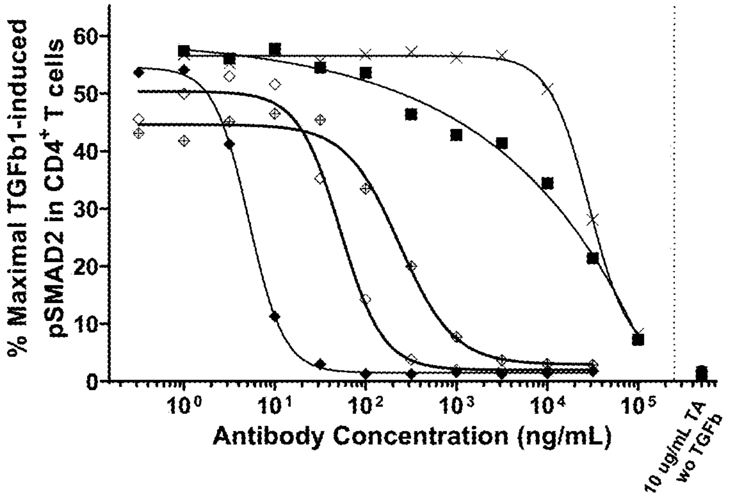

—×— XENP34306 αRSV x αTGFßRII (TBRII-A_H1L1) w/ 1 ng/ml TGFß1
—■— XENP34288 αPD1 (mAb C) x αTGFßRII (TBRII-A_H1.1_L1) w/ 1 ng/ml TGFß1
—◆— XENP35399 αCD5 (5D7) x αTGFßRII (TBRII-A_H1.1_L1) w/ 1 ng/ml TGFß1 [EC50 = 5.171]
—◇— XENP35399 αCD5 (5D7) x αTGFßRII (TBRII-A_H1.1_L1) w/ 100 ng/ml TGFß1 [EC50 = 52.76]
—◈— XENP35399 αCD5 (5D7) x αTGFßRII (TBRII-A_H1.1_L1) w/ 1000 ng/ml TGFß1 [EC50 = 236.0]

Figure 72B

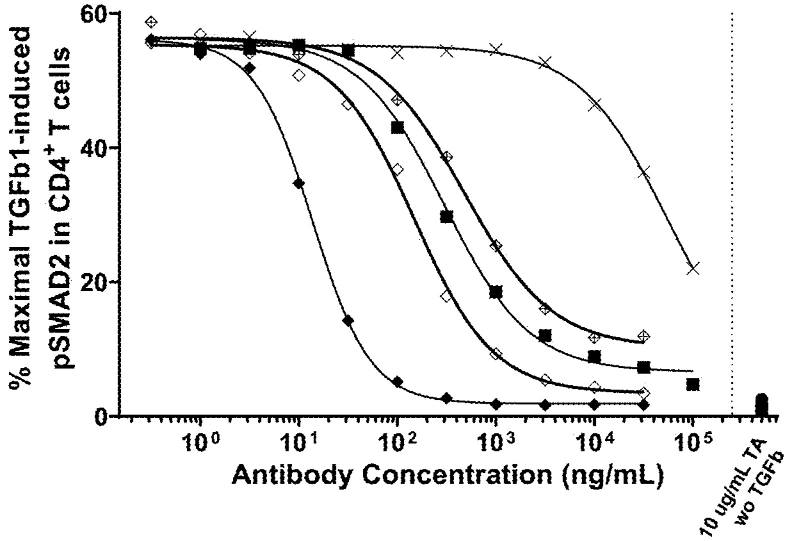

—×— XENP34306 αRSV x αTGFßRII (TBRII-A_H1L1) w/ 1 ng/ml TGFß1
—■— XENP34288 αPD1 (mAb C) x αTGFßRII (TBRII-A_H1.1_L1) w/ 1 ng/ml TGFß1 [EC50 = 300.8]
—◆— XENP35399 αCD5 (5D7) x αTGFßRII (TBRII-A_H1.1_L1) w/ 1 ng/ml TGFß1 [EC50 = 13.79]
—◇— XENP35399 αCD5 (5D7) x αTGFßRII (TBRII-A_H1.1_L1) w/ 100 ng/ml TGFß1 [EC50 = 148.2]
—◈— XENP35399 αCD5 (5D7) x αTGFßRII (TBRII-A_H1.1_L1) w/ 1000 ng/ml TGFß1 [EC50 = 476.5]

Figure 76A

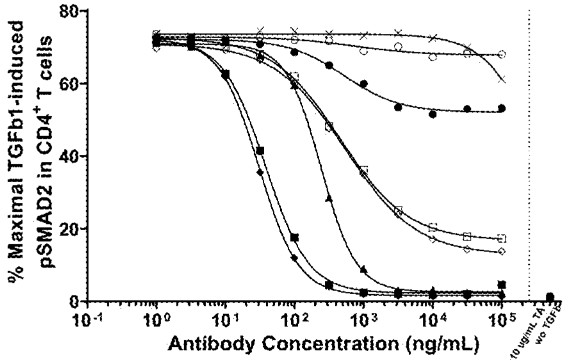

—●— XENP34288 αPD1 (mAb C) x αTGFßRII (TBRII-A_H1.1_L1) [EC50 = 525.5]
—○— XENP35105 αPD1 (mAb C) x αTGFßRII (TBRII-A_H1.30(S35Y)_L1) [EC50 = 729.1]
—■— XENP35399 αCD5 (5D7) x αTGFßRII (TBRII-A_H1.1_L1) [EC50 = 38.10]
—□— XENP36132 αCD5 (5D7) x αTGFßRII (TBRII-A_H1.30(S35Y)_L1) [EC50 = 459.5]
—▲— XENP37385 αCD5 (Cd5-A) x αTGFßRII (TBRII-A_H1.1_L1) [EC50 = 243.1]
—◆— XENP37388 αCD5 (Cd5-B) x αTGFßRII (TBRII-A_H1.1_L1) [EC50 = 30.62]
—◇— XENP37401 αCD5 (Cd5-B) x αTGFßRII (TBRII-A_H1.30(S35Y)_L1) [EC50 = 545.5]
—×— XENP34306 RSV x TGFBR2 (Prototype)

Figure 76B

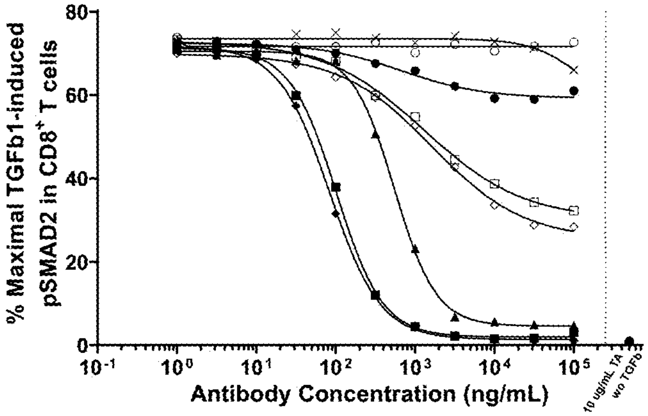

—●— XENP34288 αPD1 (mAb C) x αTGFßRII (TBRII-A_H1.1_L1) [EC50 = 672.2]
—○— XENP35105 αPD1 (mAb C) x αTGFßRII (TBRII-A_H1.30(S35Y)_L1)
—■— XENP35399 αCD5 (5D7) x αTGFßRII (TBRII-A_H1.1_L1) [EC50 = 101.7]
—□— XENP36132 αCD5 (5D7) x αTGFßRII (TBRII-A_H1.30(S35Y)_L1) [EC50 = 1304]
—▲— XENP37385 αCD5 (Cd5-A) x αTGFßRII (TBRII-A_H1.1_L1) [EC50 = 546.8]
—◆— XENP37388 αCD5 (Cd5-B) x αTGFßRII (TBRII-A_H1.1_L1) [EC50 = 87.02]
—◇— XENP37401 αCD5 (Cd5-B) x αTGFßRII (TBRII-A_H1.30(S35Y)_L1) [EC50 = 1643]
—×— XENP34306 αRSV x αTGFßRII (TBRII-A_H1L1)

Figure 83A

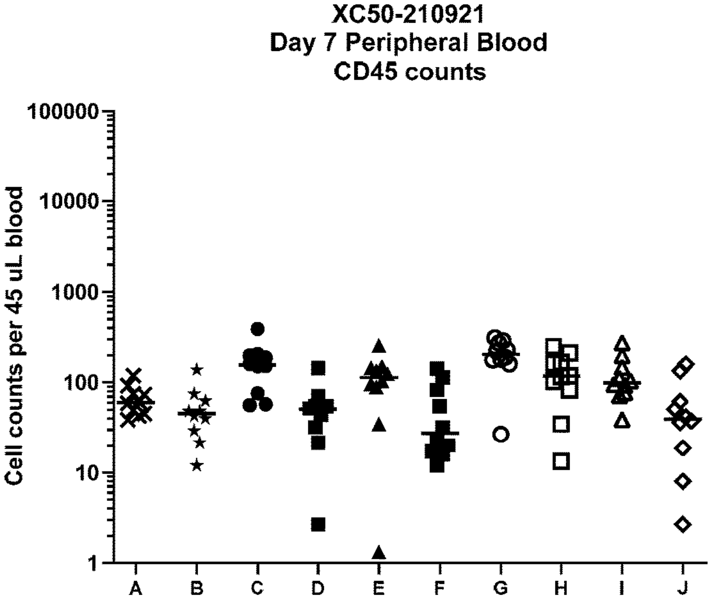

| Median | |
|---|---|
| A | 60.00 |
| B | 45.33 |
| C | 156.0 |
| D | 50.67 |
| E | 113.3 |
| F | 27.33 |
| G | 204.7 |
| H | 117.3 |
| I | 99.33 |
| J | 39.33 |

| Comparison | | P value |
|---|---|---|
| B vs A | ns | 0.1834 |
| C vs A | ** | 0.005196 |
| D vs A | ns | 0.2245 |
| E vs A | ns | 0.05243 |
| F vs A | ns | 0.1655 |
| G vs A | ** | 0.001505 |
| H vs A | ns | 0.05473 |
| I vs A | * | 0.01898 |
| J vs A | ns | 0.1487 |
| G vs B | *** | 0.0006712 |
| H vs B | * | 0.02191 |
| I vs B | ** | 0.004850 |
| J vs B | ns | 0.6698 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 83B

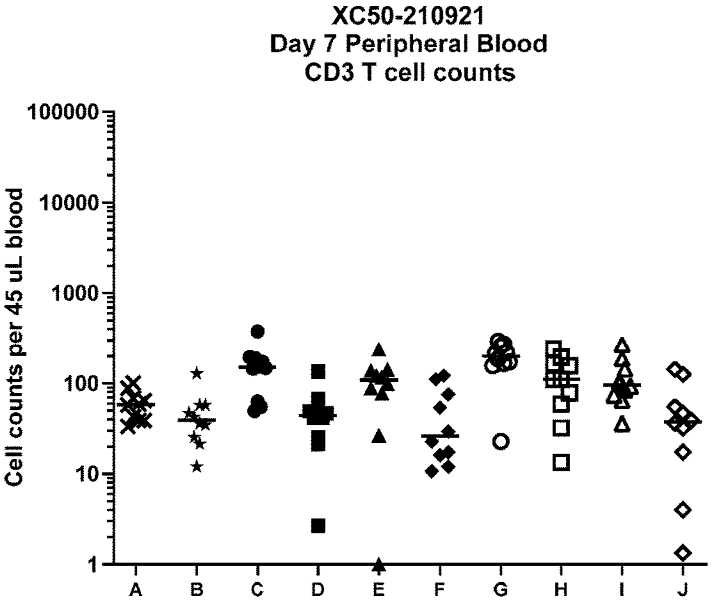

| Median | |
|---|---|
| A | 58.00 |
| B | 39.33 |
| C | 150.7 |
| D | 44.00 |
| E | 108.0 |
| F | 26.00 |
| G | 199.3 |
| H | 110.7 |
| I | 95.33 |
| J | 37.33 |

| Comparison | | P value |
|---|---|---|
| B vs A | ns | 0.1088 |
| C vs A | ** | 0.008693 |
| D vs A | ns | 0.2713 |
| E vs A | ns | 0.05472 |
| F vs A | ns | 0.1835 |
| G vs A | ** | 0.001472 |
| H vs A | ns | 0.07835 |
| I vs A | * | 0.01557 |
| J vs A | ns | 0.1649 |
| G vs B | *** | 0.0006495 |
| H vs B | * | 0.02188 |
| I vs B | ** | 0.002262 |
| J vs B | ns | 0.7815 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

Figure 83C

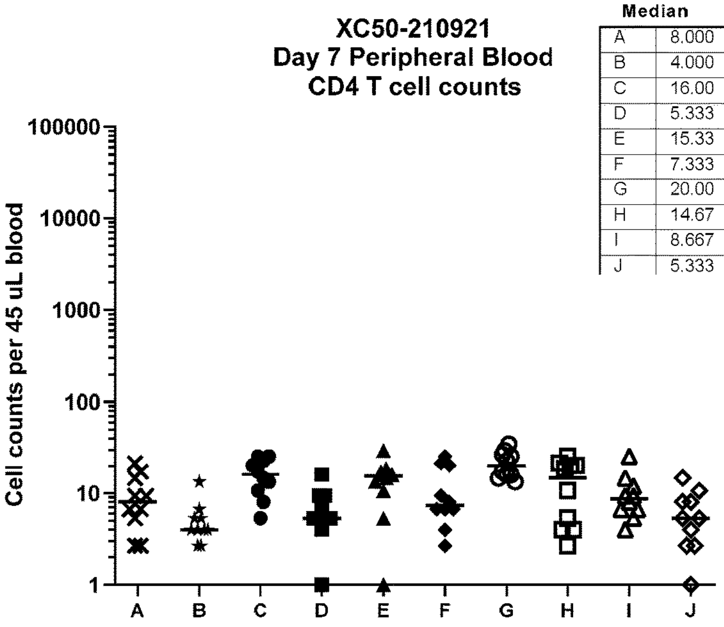

| Median | |
|---|---|
| A | 8.000 |
| B | 4.000 |
| C | 16.00 |
| D | 5.333 |
| E | 15.33 |
| F | 7.333 |
| G | 20.00 |
| H | 14.67 |
| I | 8.667 |
| J | 5.333 |

| Comparison | | P value |
|---|---|---|
| B vs A | ns | 0.06819 |
| C vs A | * | 0.04445 |
| D vs A | ns | 0.2992 |
| E vs A | ns | 0.1986 |
| F vs A | ns | 0.7536 |
| G vs A | ** | 0.001970 |
| H vs A | ns | 0.4263 |
| I vs A | ns | 0.7804 |
| J vs A | ns | 0.2208 |
| G vs B | **** | 2.165e-005 |
| H vs B | ns | 0.05518 |
| I vs B | ** | 0.007437 |
| J vs B | ns | 0.6087 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 83D

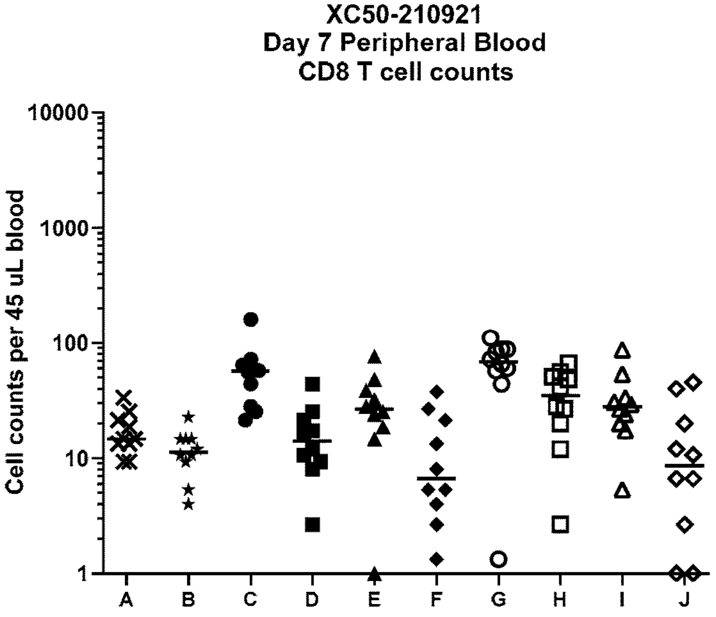

| Median | |
|---|---|
| A | 14.67 |
| B | 11.33 |
| C | 56.67 |
| D | 14.00 |
| E | 26.67 |
| F | 6.667 |
| G | 68.67 |
| H | 34.67 |
| I | 28.00 |
| J | 8.667 |

| Comparison | | P value |
|---|---|---|
| B vs A | ns | 0.1338 |
| C vs A | *** | 0.0001840 |
| D vs A | ns | 0.6163 |
| E vs A | * | 0.04958 |
| F vs A | ns | 0.1266 |
| G vs A | ** | 0.001310 |
| H vs A | * | 0.04119 |
| I vs A | * | 0.03696 |
| J vs A | ns | 0.1588 |
| G vs B | ** | 0.001364 |
| H vs B | ** | 0.007199 |
| I vs B | ** | 0.001548 |
| J vs B | ns | 0.5903 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

Figure 84A

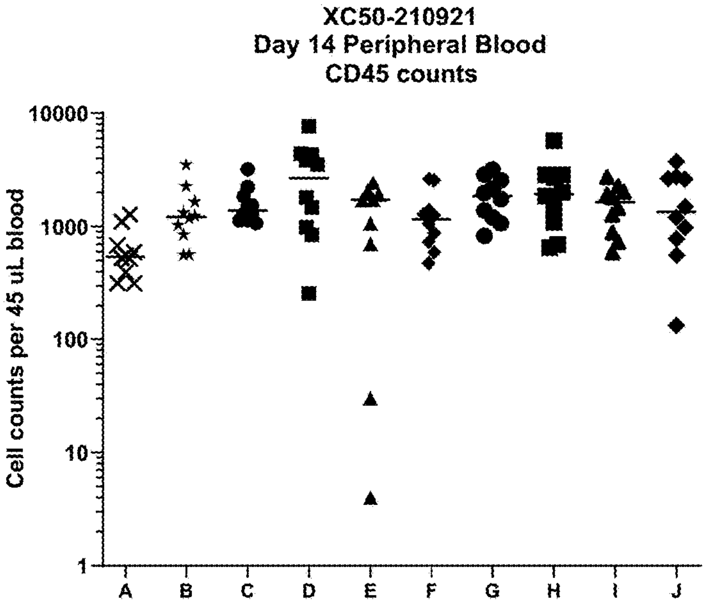

| Median | |
|---|---|
| A | 540.7 |
| B | 1213 |
| C | 1383 |
| D | 2666 |
| E | 1717 |
| F | 1155 |
| G | 1859 |
| H | 1927 |
| I | 1637 |
| J | 1348 |

| Comparison | | P value |
|---|---|---|
| B vs A | ** | 0.005196 |
| C vs A | *** | 0.0001299 |
| D vs A | ** | 0.005196 |
| E vs A | ns | 0.05243 |
| F vs A | * | 0.01469 |
| G vs A | *** | 0.0002057 |
| H vs A | *** | 0.0004871 |
| I vs A | *** | 0.0007253 |
| J vs A | * | 0.01854 |
| G vs B | ns | 0.1655 |
| H vs B | ns | 0.1903 |
| I vs B | ns | 0.3930 |
| J vs B | ns | 0.7959 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 84B

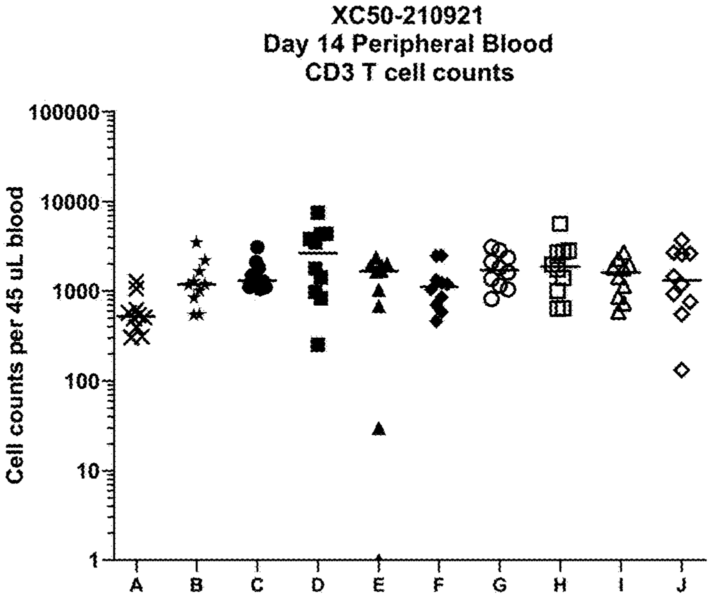

| Median | |
|---|---|
| A | 522.7 |
| B | 1180 |
| C | 1306 |
| D | 2633 |
| E | 1663 |
| F | 1111 |
| G | 1705 |
| H | 1855 |
| I | 1605 |
| J | 1315 |

| Comparison | | P value |
|---|---|---|
| B vs A | ** | 0.005196 |
| C vs A | *** | 0.0001299 |
| D vs A | ** | 0.005196 |
| E vs A | ns | 0.05243 |
| F vs A | * | 0.01469 |
| G vs A | *** | 0.0002057 |
| H vs A | *** | 0.0003248 |
| I vs A | *** | 0.0007253 |
| J vs A | * | 0.01854 |
| G vs B | ns | 0.2176 |
| H vs B | ns | 0.2176 |
| I vs B | ns | 0.4813 |
| J vs B | ns | 0.6842 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

Figure 84C

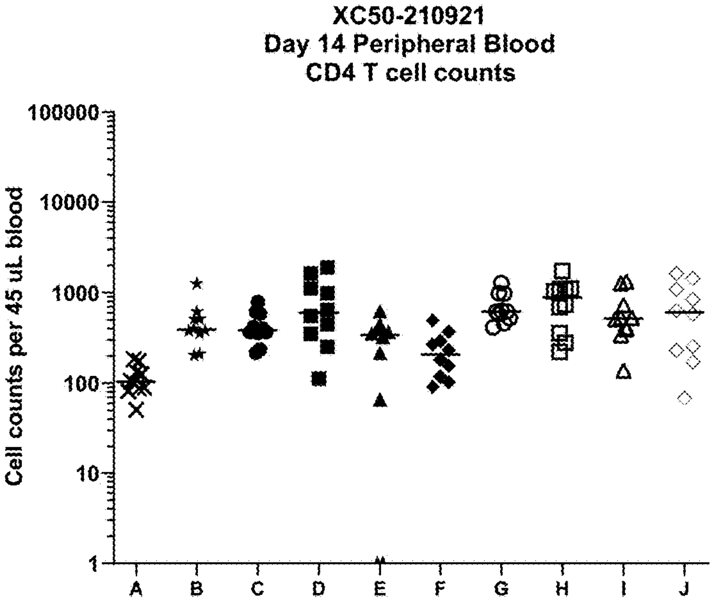

| Median | |
|---|---|
| A | 103.3 |
| B | 390.0 |
| C | 385.1 |
| D | 597.3 |
| E | 339.3 |
| F | 206.9 |
| G | 615.0 |
| H | 882.0 |
| I | 516.7 |
| J | 604.0 |

| Comparison | | P value |
|---|---|---|
| B vs A | **** | 1.083e-005 |
| C vs A | **** | 1.083e-005 |
| D vs A | *** | 0.0001299 |
| E vs A | ns | 0.1192 |
| F vs A | * | 0.01469 |
| G vs A | **** | 1.083e-005 |
| H vs A | **** | 1.083e-005 |
| I vs A | **** | 4.330e-005 |
| J vs A | ** | 0.002089 |
| G vs B | * | 0.01220 |
| H vs B | ns | 0.1230 |
| I vs B | ns | 0.3150 |
| J vs B | ns | 0.5288 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 84D

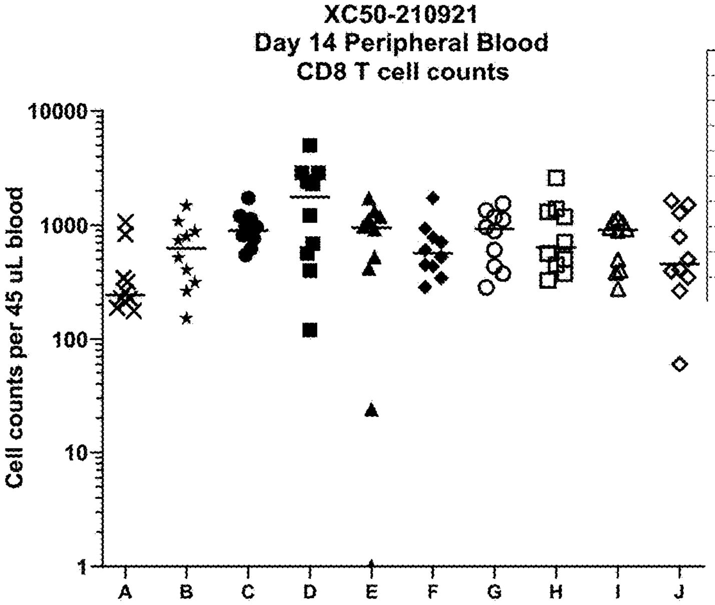

| Median | |
|---|---|
| A | 243.3 |
| B | 626.0 |
| C | 896.2 |
| D | 1758 |
| E | 947.3 |
| F | 566.5 |
| G | 924.7 |
| H | 637.3 |
| I | 910.7 |
| J | 455.3 |

| Comparison | | P value |
|---|---|---|
| B vs A | ns | 0.08921 |
| C vs A | ** | 0.002879 |
| D vs A | ** | 0.008931 |
| E vs A | ns | 0.07526 |
| F vs A | * | 0.02323 |
| G vs A | ** | 0.002879 |
| H vs A | ** | 0.003886 |
| I vs A | ** | 0.004005 |
| J vs A | ns | 0.05243 |
| G vs B | ns | 0.2176 |
| H vs B | ns | 0.4359 |
| I vs B | ns | 0.3930 |
| J vs B | ns | 0.9705 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1 v (A) PBS
(B) XENP16432 Anti-PD1, 3 mg/kg
(C) XENP40323 CD5^ x TGFBR2 (H1.201_L1), 5 mg/kg
(D) XENP39131 CD5^ x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5^ x TGFBR2 (H1.201_L1), 5 mg/kg + XENP16432 Anti-PD1, 3 mg/k
(H) XENP39131 CD5^ x TGFBR2 (H1.212_L1), 5 mg/kg + XENP16432 Anti-PD1, 3 mg/k
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
^CD5 is Cd5-B_H2L1

(A) PBS
(B) XENP16432 Anti-PD1, 3 mg/kg
(C) XENP40323 CD5' x TGFBR2 (H1.201_L1), 5 mg/kg
(D) XENP39131 CD5' x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5' x TGFBR2 (H1.201_L1), 5 mg/kg + XENP16432 Anti-PD1, 3 mg/k
(H) XENP39131 CD5' x TGFBR2 (H1.212_L1), 5 mg/kg + XENP16432 Anti-PD1, 3 mg/k
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
'CD5 is Cd5-B_H2L1

Figure 86

Human PD-1 sequence (SEQ ID NO: 1890)

>sp|Q15116
MQIPQAPWPVVWAVLQLGWRPGWFLDSPDRPWNPPTFSPALLVVTEGDNATFTCSFSNTSESFVLNWYRMSPSNQTD
KLAAFPEDRSQPGQDCRFRVTQLPNGRDFHMSVVRARRNDSGTYLCGAISLAPKAQIKESLRAELRVTERRAEVPTA
HPSPSPRPAGQFQTLVVGVVGGLLGSLVLLVWVLAVICSRAARGTIGARRTGQPLKEDPSAVPVFSVDYGELDFQWR
EKTPEPPVPCVPEQTEYATIVFPSGMGTSSPARRGSADGPRSAQPLRPEDGHCSWPL

Human PD-1 sequence, extracellular domain (SEQ ID NO: 1891)

>sp|Q15116|21-170
PGWFLDSPDRPWNPPTFSPALLVVTEGDNATFTCSFSNTSESFVLNWYRMSPSNQTDKLAAFPEDRSQPGQDCRFRV
TQLPNGRDFHMSVVRARRNDSGTYLCGAISLAPKAQIKESLRAELRVTERRAEVPTAHPSPSPRPAGQFQTLV

Macaca fascicularis PD-1 sequence (SEQ ID NO: 1892)

>tr|B0LAJ3
MQIPQAPWPVVWAVLQLGWRPGWFLESPDRPWNAPTFSPALLLVTEGDNATFTCSFSNASESFVLNWYRMSPSNQTD
KLAAFPEDRSQPGQDCRFRVTRLPNGRDFHMSVVRARRNDSGTYLCGAISLAPKAQIKESLRAELRVTERRAEVPTA
HPSPSPRPAGQFQALVVGVVGGLLGSLVLLVWVLAVICSRAAQGTIEARRTGQPLKEDPSAVPVFSVDYGELDFQWR
EKTPEPPAPCVPEQTEYATIVFPSGLGTSSPARRGSADGPRSPRPLRPEDGHCSWPL

Macaca fascicularis PD-1 sequence, extracellular domain (predicted) (SEQ ID NO: 1893)

>tr|B0LAJ3|21-170
PGWFLESPDRPWNAPTFSPALLLVTEGDNATFTCSFSNASESFVLNWYRMSPSNQTDKLAAFPEDRSQPGQDCRFRV
TRLPNGRDFHMSVVRARRNDSGTYLCGAISLAPKAQIKESLRAELRVTERRAEVPTAHPSPSPRPAGQFQALV

Figure 87A

| TBRII-A VH | SEQ | SEQ ID | |
|---|---|---|---|
| HFR1 | $QX_1QX_2QESGX_3GLVKPSX_4TLSLTCX_5VSGX_6SX_7$ | 2341 | $X_1$ is selected from L, V; $X_2$ is selected from V, L; $X_3$ is selected from P, S; $X_4$ is selected from E, Q; $X_5$ is selected from T, A; $X_6$ is selected from G, Y; $X_7$ is selected from I, F, V |
| HCDR1 | $X_1X_2X_3X_4X_5X_6X_7$ | 2342 | X1 is selected from N, D, E, G, S, T, Q, R, H; $X_2$ is selected from S, A, G, T, H; $X_3$ is selected from Y, A, D, G, H; $X_4$ is selected from F, H, S, Y; $X_5$ is selected from S, A, T, Y, H; $X_6$ is selected from W, I, M; $X_7$ is selected from G, A, H, N, S |
| HFR2 | $WX_1RQX_2PGKGLEWIG$ | 2343 | $X_1$ is selected from I, V; $X_2$ is selected from P, A, H |
| HCDR2 | $SFX_1X_2GX_3X_4X_5X_6YX_7PSLX_8X_9$ | 2344 | $X_1$ is selected from Y, D, H, K, N, S; $X_2$ is selected from Y, H, S; $X_3$ is selected from E, G, S; $X_4$ is selected from K, D, N, S ; $X_5$ is selected from T, I; $X_6$ is selected from Y, F, H, N, S; $X_7$ is selected from N, A, S; $X_8$ is selected from K, E, Q; $X_9$ is selected from S, G |
| HFR3 | $RX_1TISX_2DX_3SKX_4QFSLX_5LSSVTAX_6DTAVYYCX_7R$ | 2345 | $X_1$ is selected from A, F, V; $X_2$ is selected from I, V; $X_3$ is selected from T, H; $X_4$ is selected from S, N, H; $X_5$ is selected from K, Q; $X_6$ is selected from A, E, V; $X_7$ is selected from P, A |
| HCDR3 | $GPX_1X_2X_3X_4GVX_5DX_6$ | 2346 | $X_1$ is selected from T, A, D, N, S; $X_2$ is selected from M, V, A, E, S, T, Q, L, I, H; $X_3$ is selected from I, A, D, N, V; $X_4$ is selected from R, A, H, E, K, Q, S; $X_5$ is selected from I, F, M; $X_6$ is selected from S, H, L, V, Y |
| HFR4 | $WGQGTX_1VTVSS$ | 2347 | $X_1$ is selected from L, M, T |

Figure 87B

| **TBRII-A VL** | | | |
|---|---|---|---|
| LFR1 | $EIVX_1TQSPX_2TLSX_3SPGERX_4TLSC$ | 2348 | $X_1$ is selected from L, M; $X_2$ is selected from A, G, P; $X_3$ is selected from L, V; $X_4$ is selected from A, V |
| LCDR1 | $X_1ASQX_2VX_3X_4X_5LX_6$ | 2349 | $X_1$ is selected from R, G; $X_2$ is selected from S, G; $X_3$ is selected from R, K, Q, S; $X_4$ is selected from S, N, T; $X_5$ is selected from Y, H, N; $X_6$ is selected from A, N, S, T |
| LFR2 | $WYQQKPGX_1APRLLIY$ | 2350 | $X_1$ is selected from Q, K, L |
| LCDR2 | $X_1ASX_2RAX_3$ | 2351 | $X_1$ is selected from D, E, G, S; $X_2$ is selected from N, D, S, T, H; $X_3$ is selected from T, S |
| LFR3 | $X_1X_2PX_3RFSGSGSGTX_4FTLTISX_5LX_6X_7EDFAX_8YYC$ | 2352 | $X_1$ is selected from G, S; $X_2$ is selected from I, V; $X_3$ is selected from A, D; $X_4$ is selected from D, E; $X_5$ is selected from S, R; $X_6$ is selected from E, Q; $X_7$ is selected from P, S; $X_8$ is selected from V, T |
| LCDR3 | $QQRX_1X_2X_3PX_4T$ | 2353 | $X_1$ is selected from S, A, G, N, T, H; $X_2$ is selected from N, D, S, Q, H ; $X_3$ is selected from W, H, V, I, L, S, Y; $X_4$ is selected from P, F, I, L, W, Y |
| LFR4 | $FGX_1GTKX_2EIK$ | 2354 | $X_1$ is selected from Q, G, P; $X_2$ is selected from V, L |

Figure 88A

| Cd5-B VH | SEQ | SEQ ID NO: | |
|---|---|---|---|
| HFR1 | $X_1VX_2LX_3X_4SGAEX_5X_6X_7PGX_8SX_9KX_{10}SCKASGYSFT$ | 2355 | $X_1$ is selected from E, Q; $X_2$ is selected from Q, T; $X_3$ is selected from V, K; $X_4$ is selected from Q, E; $X_5$ is selected from V, L; $X_6$ is selected from K, V; $X_7$ is selected from K, R; $X_8$ is selected from E, A; $X_9$ is selected from L, V; $X_{10}$ is selected from I, V |
| HCDR1 | $SYWX_1X_2$ | 2356 | $X_1$ is selected from M, I, L, V; $X_2$ is selected from N, G, Q, D |
| HFR2 | $WVX_1QX_2PGX_3GLEWX_4G$ | 2357 | $X_1$ is selected from R, K; $X_2$ is selected from M, A, R; $X_3$ is selected from K, Q; $X_4$ is selected from M, I |
| HCDR2 | $X_1IX_2PX_3DSX_4TRX_5X_6X_7X_8FX_9X_{10}$ | 2358 | $X_1$ is selected from M, I, L, V; $X_2$ is selected from H, Y, F, W; $X_3$ is selected from S, G, T, A; $X_4$ is selected from E, D, Q, N; $X_5$ is selected from Y, L; $X_6$ is selected from N, S, T; $X_7$ is selected from Q, P; $X_8$ is selected from S, K; $X_9$ is selected from Q, K; $X_{10}$ is selected from G, D |
| HFR3 | $X_1X_2TX_3X_4VDKSX_5STAYX_6X_7X_8SSX_9X_{10}X_{11}X_{12}DX_{13}AX_{14}YYCAR$ | 2359 | $X_1$ is selected from Q, K, R; $X_2$ is selected from V, A; $X_3$ is selected from I, L, M; $X_4$ is selected from S, T; $X_5$ is selected from I, T; $X_6$ is selected from L, M; $X_7$ is selected from Q, E; $X_8$ is selected from W, L; $X_9$ is selected from L, P; $X_{10}$ is selected from K, T, R; $X_{11}$ is selected from A, S; $X_{12}$ is selected from S, E; $X_{13}$ is selected from T, S; $X_{14}$ is selected from M, V |
| HCDR3 | WGDHDDAMDF | 2360 | |
| HFR4 | WGQGTMVTVSS | 2361 | |

Figure 88B

| **Cd5-B VL** | | | |
|---|---|---|---|
| LFR1 | DIVLTQSP$X_1$SL$X_2$$X_3$S$X_4$G$X_5$R$X_6$TI$X_7$C | 2362 | $X_1$ is selected from S, D; $X_2$ is selected from S, A; $X_3$ is selected from A, V; $X_4$ is selected from V, L; $X_5$ is selected from D, E; $X_6$ is selected from V, A; $X_7$ is selected from T, N |
| LCDR1 | $X_1$PSENIYGYFA | 2363 | $X_1$ is selected from R, K |
| LFR2 | WYQQKPG$X_1$SPKLLVY | 2364 | $X_1$ is selected from K, Q |
| LCDR2 | NAKTLAE | 2365 | |
| LFR3 | GVPSRFSGSGSGTDFTLTISSLQ$X_1$ED$X_2$A$X_3$YYC | 2366 | $X_1$ is selected from P, A; $X_2$ is selected from F, V; $X_3$ is selected from T, V |
| LCDR3 | QHHYGTPFT | 2367 | |
| LFR4 | FGPGTKVEIK | 2368 | |

Figure 89A

TBRII-A_H1.1

| | Sequence | SEQ ID NO: |
|---|---|---|
| Variable heavy (vh) domain | QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSS | 2369 |
| vhCDR1 | NSYFSWG | 2370 |
| vhCDR2 | SFYYGEKTYYNPSLKS | 2371 |
| vhCDR3 | GPTVIRGVIDS | 2372 |

TBRII-A_H1.29

| | Sequence | SEQ ID NO: |
|---|---|---|
| Variable heavy (vh) domain | QLQVQESGPGLVKPSETLSLTCTVSGGSISNSYFTWGWIRQPPGKGLEWIGSFYYGEKTYYNPSLKSRATISIDTSKSQFSLKLSSVTAADTAVYYCPRGPTMIRGVIDSWGQGTLVTVSS | 2373 |
| vhCDR1 | NSYFTWG | 2374 |
| vhCDR2 | SFYYGEKTYYNPSLKS | 2375 |
| vhCDR3 | GPTMIRGVIDS | 2376 |

TBRII-A_H1.30

| | Sequence | SEQ ID NO: |
|---|---|---|
| Variable heavy (vh) domain | QLQVQESGPGLVKPSETLSLTCTVSGGSISNSYFYWGWIRQPPGKGLEWIGSFYYGEKTYYNPSLKSRATISIDTSKSQFSLKLSSVTAADTAVYYCPRGPTMIRGVIDSWGQGTLVTVSS | 2377 |
| vhCDR1 | NSYFYWG | 2378 |
| vhCDR2 | SFYYGEKTYYNPSLKS | 2379 |
| vhCDR3 | GPTMIRGVIDS | 2380 |

TBRII-A_H1.36

| | Sequence | SEQ ID NO: |
|---|---|---|
| Variable heavy (vh) domain | QLQVQESGPGLVKPSETLSLTCTVSGGSISNSYFSWSWIRQPPGKGLEWIGSFYYGEKTYYNPSLKSRATISIDTSKSQFSLKLSSVTAADTAVYYCPRGPTMIRGVIDSWGQGTLVTVSS | 2381 |
| vhCDR1 | NSYFSWS | 2382 |
| vhCDR2 | SFYYGEKTYYNPSLKS | 2383 |
| vhCDR3 | GPTMIRGVIDS | 2384 |

Figure 89B

TBRII-A_H1.51

| | Sequence | SEQ ID NO: |
|---|---|---|
| Variable heavy (vh) domain | QLQVQESGPGLVKPSETLSLTCTVSGGSISNSYFSWGWIRQPPGKGLEWIGSFNYGEKTYYNPSLKSRATISIDTSKSQFSLKLSSVTAADTAVYYCPRGPTMIRGVIDSWGQGTLVTVSS | 2385 |
| vhCDR1 | NSYFSWG | 2386 |
| vhCDR2 | SFNYGEKTYYNPSLKS | 2387 |
| vhCDR3 | GPTMIRGVIDS | 2388 |

TBRII-A_H1.201

| | Sequence | SEQ ID NO: |
|---|---|---|
| Variable heavy (vh) domain | QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTLIRGVIDSWGQGTLVTVSS | 2389 |
| vhCDR1 | NAYFSWG | 2390 |
| vhCDR2 | SFYYGGKTYYNPSLKS | 2391 |
| vhCDR3 | GPTLIRGVIDS | 2392 |

TBRII-A_H1.212

| | Sequence | SEQ ID NO: |
|---|---|---|
| Variable heavy (vh) domain | QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTTIRGVIDSWGQGTLVTVSS | 2393 |
| vhCDR1 | SSYFSWS | 2394 |
| vhCDR2 | SFYYGGKTYYNPSLKS | 2395 |
| vhCDR3 | GPTTIRGVIDS | 2396 |

B) Exemplary TBRII-A based VL

TBRII-A_L1

| | Sequence | SEQ ID NO: |
|---|---|---|
| Variable light (vl) domain | EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK | 1867 |
| vlCDR1 | RASQSVRSYLA | 1868 |
| vlCDR2 | DASNRAT | 1869 |
| vlCDR3 | QQRSNWPPT | 1870 |

Figure 90A

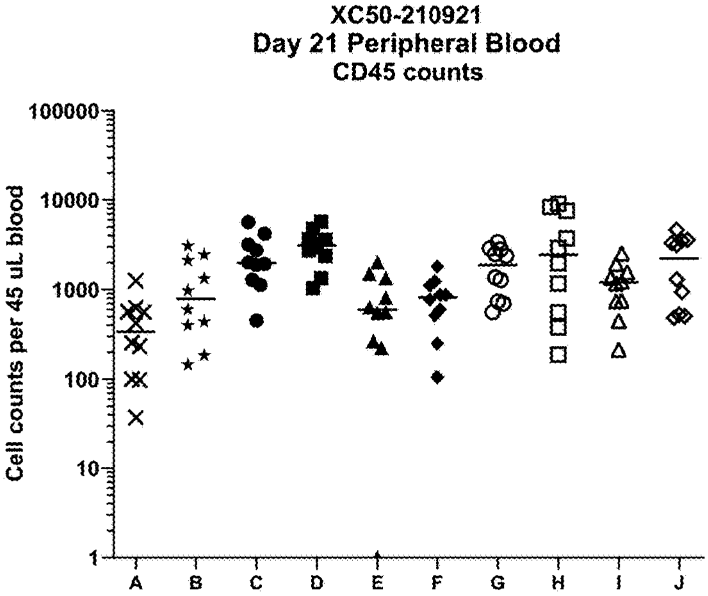

Median

| | |
|---|---|
| A | 336.7 |
| B | 786.0 |
| C | 1969 |
| D | 3115 |
| E | 596.7 |
| F | 818.7 |
| G | 1871 |
| H | 2436 |
| I | 1201 |
| J | 2227 |

| Comparison | | P value |
|---|---|---|
| B vs A | ns | 0.07526 |
| C vs A | *** | 0.0002057 |
| D vs A | **** | 2.165e-005 |
| E vs A | ns | 0.1903 |
| F vs A | ns | 0.05012 |
| G vs A | *** | 0.0003248 |
| H vs A | * | 0.01150 |
| I vs A | ** | 0.006841 |
| J vs A | ** | 0.003886 |
| G vs B | ns | 0.1051 |
| H vs B | ns | 0.1431 |
| I vs B | ns | 0.5787 |
| J vs B | ns | 0.08921 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 90B

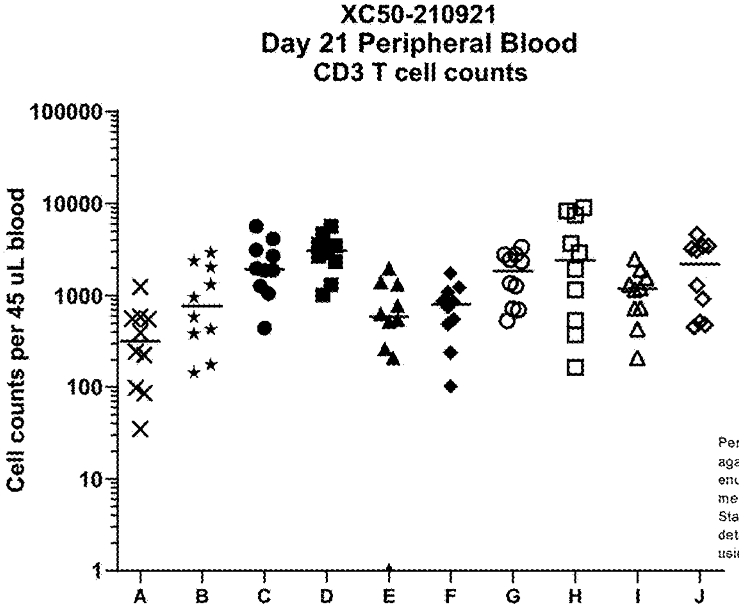

Median

| | |
|---|---|
| A | 318.7 |
| B | 768.0 |
| C | 1926 |
| D | 3078 |
| E | 588.7 |
| F | 805.3 |
| G | 1851 |
| H | 2418 |
| I | 1185 |
| J | 2191 |

| Comparison | | P value |
|---|---|---|
| B vs A | ns | 0.07526 |
| C vs A | *** | 0.0002057 |
| D vs A | **** | 2.165e-005 |
| E vs A | ns | 0.1903 |
| F vs A | ns | 0.07526 |
| G vs A | *** | 0.0003248 |
| H vs A | * | 0.01150 |
| I vs A | ** | 0.006841 |
| J vs A | ** | 0.003886 |
| N vs A | ** | 0.001505 |
| G vs B | ns | 0.1051 |
| H vs B | ns | 0.1655 |
| I vs B | ns | 0.5922 |
| J vs B | ns | 0.08921 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

Figure 90C

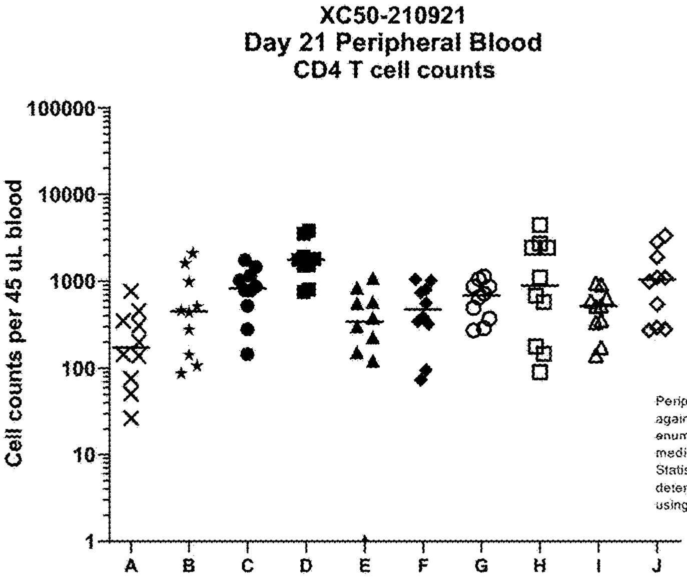

| Median | |
|---|---|
| A | 172.0 |
| B | 450.7 |
| C | 826.0 |
| D | 1769 |
| E | 340.7 |
| F | 471.3 |
| G | 684.0 |
| H | 891.3 |
| I | 519.3 |
| J | 1041 |

| Comparison | | P value |
|---|---|---|
| B vs A | ns | 0.1051 |
| C vs A | ** | 0.001505 |
| D vs A | **** | 2.165e-005 |
| E vs A | ns | 0.2475 |
| F vs A | ns | 0.06301 |
| G vs A | ** | 0.003886 |
| H vs A | * | 0.01854 |
| I vs A | * | 0.02323 |
| J vs A | ** | 0.003886 |
| G vs B | ns | 0.4359 |
| H vs B | ns | 0.1655 |
| I vs B | ns | 0.7394 |
| J vs B | ns | 0.1280 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

Figure 90D

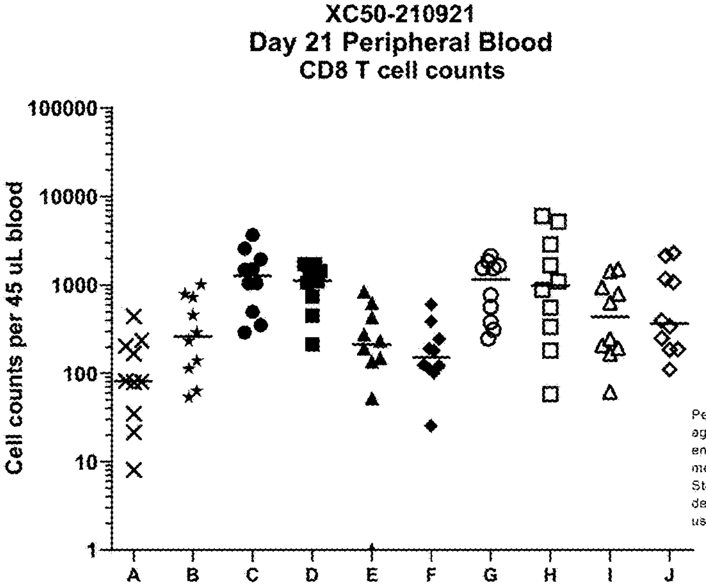

| Median | |
|---|---|
| A | 80.67 |
| B | 263.3 |
| C | 1272 |
| D | 1118 |
| E | 214.0 |
| F | 153.3 |
| G | 1160 |
| H | 992.0 |
| I | 438.0 |
| J | 369.3 |

| Comparison | | P value |
|---|---|---|
| B vs A | ns | 0.06301 |
| C vs A | **** | 4.330e-005 |
| D vs A | **** | 4.330e-005 |
| E vs A | ns | 0.1903 |
| F vs A | ns | 0.1903 |
| G vs A | **** | 7.578e-005 |
| H vs A | ** | 0.002089 |
| I vs A | * | 0.01150 |
| J vs A | ** | 0.003886 |
| G vs B | * | 0.01469 |
| H vs B | * | 0.04326 |
| I vs B | ns | 0.3527 |
| J vs B | ns | 0.2176 |

Peripheral blood samples were stained with an antibody cocktail against surface antigens and analyzed by flow cytometry to enumerate cell subsets. Cell count values of 0 were set to 1 for median calculations, analyses, and plotting.
Statistical significance of cell counts for group comparisons were determined using an unpaired Mann-Whitney nonparametric test using Prism. * P <0.05 ,  P <0.01, * P <0.001, **** P <0.0001.

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

(A) PBS
(B) XENP16432 Anti-PD1, 3 mg/kg
(C) XENP40323 CD5* x TGFBR2 (H1.201_L1), 5 mg/kg
(D) XENP39131 CD5* x TGFBR2 (H1.212_L1), 5 mg/kg
(E) XENP36981 RSV x TGFBR2 (H1.201_L1), 5 mg/kg
(F) XENP39137 RSV x TGFBR2 (H1.212_L1), 5 mg/kg
(G) XENP40323 CD5* x TGFBR2 (H1.201_L1), 5 mg/kg + XENP16432 Anti-PD1, 3 mg/kg
(H) XENP39131 CD5* x TGFBR2 (H1.212_L1), 5 mg/kg + XENP16432 Anti-PD1, 3 mg/kg
(I) XENP36981 RSV x TGFBR2 (H1.201_L1), 5 mg/kg + XENP16432 Anti-PD1, 3 mg/kg
(J) XENP39137 RSV x TGFBR2 (H1.212_L1), 5 mg/kg + XENP16432 Anti-PD1, 3 mg/kg
*CD5 is Cd5-B_H2L1

Figure 92

>XENP40323Xtend Cd5-B[CD5]_H2L1_Fab-TBRII-A[TGFßRII]_H1.201_L1_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 - Cd5-B[CD5]_H2_IgG1_pI(-)_Isosteric_A_/PVA_/S267K/L368D/K370S/M428L/N434S (SEQ ID NO: 2401-2404)

QVQLVQSGAEVKKPGASVKVSCKASGYSFTSYWMNWVRQAPGQGLEWMGMIHPSDSETRYNQKFQGRVTMTVDKSTSTAYME
LSSLRSEDTAVYYCARWGDHDDAMDFWGQGTMVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSDTKVDKKVEPKSCDKTHTCPPCPAPPVAGPSVFLFP
PKPKDTLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGSFFLYS
KLTVDKSRWEQGDVFSCSVLHEALHSHYTQKSLSLSPGK

Chain 2 - TBRII-A[TGFßRII]_H1.201_L1_scFv(GKPGS)4_Fc(216)_IgG1_C220S/PVA_/S267K/S364K/E357Q/M428L/N434S (SEQ ID NO: 2405-2411)

QLQVQESGPGLVKPSETLSLTCTVSGGSISNAYFSWGWIRQPPGKGLEWIGSFYYGGKTYYNPSLKSRATISIDTSKNQFSL
KLSSVTAADTAVYYCARGPTLIRGVIDSWGQGTLVTVSSGKPGSGKPGSGKPGSGKPGSEIVLTQSPATLSLSPGERATLSC
RASQSVRSYLAWYQQKPGQAPRLLIYDASNRATGIPARFSGSGSGTDFTLTISSLEPEDFAVYYCQQRSNWPPTFGQGTKVE
IK/EPKSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVLHEALHSHYTQKSLSLSPGK

Chain 3 - Cd5-B[CD5]_L1 Light Chain (SEQ ID NO: 2412-2415)

DIVLTQSPSSLSASVGDRVTITCRPSENIYGYFAWYQQKPGKSPKLLVYNAKTLAEGVPSRFSGSGSGTDFTLTISSLQPED
FATYYCQHHYGTPFTFGPGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

>XENP39131Xtend Cd5-B[CD5]_H2L1_Fab-TBRII-A[TGFßRII]_H1.212_L1_scFv(GKPGS)4-IgG1_pI(-)_Isosteric_A_/PVA_/S267K/L368D/K370S/-Fc(216)_IgG1_C220S/PVA_/S267K/S364K/E357Q/M428L/N434S

Chain 1 - Cd5-B[CD5]_H2_IgG1_pI(-)_Isosteric_A_/PVA_/S267K/L368D/K370S/M428L/N434S (SEQ ID NO:2416-2419)

QVQLVQSGAEVKKPGASVKVSCKASGYSFTSYWMNWVRQAPGQGLEWMGMIHPSDSETRYNQKFQGRVTMTVDKSTSTAYME
LSSLRSEDTAVYYCARWGDHDDAMDFWGQGTMVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSDTKVDKKVEPKSCDKTHTCPPCPAPPVAGPSVFLFP
PKPKDTLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGSFFLYS
KLTVDKSRWEQGDVFSCSVLHEALHSHYTQKSLSLSPGK

Chain 2 - TBRII-A[TGFßRII]_H1.212_L1_scFv(GKPGS)4_Fc(216)_IgG1_C220S/PVA_/S267K/S364K/E357Q/M428L/N434S (SEQ ID NO: 2420-2426)

QLQVQESGPGLVKPSETLSLTCTVSGGSISSSYFSWSWIRQPPGKGLEWIGSFYYGGKTYYNPSLKSRATISIDTSKNQFSL
KLSSVTAADTAVYYCARGPTTIRGVIDSWGQGTLVTVSSGKPGSGKPGSGKPGSGKPGSEIVLTQSPATLSLSPGERATLSC
RASQSVRSYLAWYQQKPGQAPRLLIYDASNRATGIPARFSGSGSGTDFTLTISSLEPEDFAVYYCQQRSNWPPTFGQGTKVE
IK/EPKSSDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVLHEALHSHYTQKSLSLSPGK

Chain 3 - Cd5-B[CD5]_L1 Light Chain (SEQ ID NO: 2427-2430)

DIVLTQSPSSLSASVGDRVTITCRPSENIYGYFAWYQQKPGKSPKLLVYNAKTLAEGVPSRFSGSGSGTDFTLTISSLQPED
FATYYCQHHYGTPFTFGPGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

HETERODIMERIC ANTIBODIES THAT BIND TGFβRII

PRIORITY

This application claims the benefit of U.S. Provisional Patent Application No. 63/110,908, filed Nov. 6, 2020, which is hereby incorporated by reference in its entirety.

SEQUENCE LISTING INCORPORATION PARAGRAPH

The instant application contains a Sequence Listing which has been submitted electronically in ASCII format and is hereby incorporated by reference in its entirety. Said ASCII copy, created on Nov. 5, 2021, is named 067461-5277-WO_SL.txt and is 2,853,990 bytes in size.

BACKGROUND

One mechanism by which tumors evade immune surveillance is by producing the immunosuppressive cytokine TGFß which directly inhibits the expression of cytolytic proteins such as IFNγ which are necessary for T cell-mediated tumor cytotoxicity. Additionally, TGFß is pro-fibrotic and promotes the expansion of fibroblasts. Cancer-associated fibroblasts (CAFs) have been reported to promote tumor survival and proliferation (Orimo et al., 2006; Xing et al., 2011), for example by providing growth factors for angiogenesis and by further encouraging an immunosuppressive environment, and have been associated with poor prognosis (Underwood et al, 2015).

Accordingly, a number of therapies have been developed to block the TGFß/TGFßR axis such as anti-TGFßRII antibodies. However, such therapies have varied in success. For example, an anti-TGFßRII mAb resulted in uncontrolled cytokine release syndrome. Therefore, there is a need and potential for effective therapy targeting the TGFß/TGFßR axis with enhanced safety profiles.

SUMMARY

Provided herein are novel antibodies that bind TGFßRII. In some embodiments, the anti-TGFßRII antibodies bispecific heterodimeric antibodies. In some embodiments, the anti-TGFßRII antibodies are anti-TGFßRII×anti-CD5 bispecific antibodies. In some embodiments, the anti-TGFßRII antibodies are anti-TGFßRII×anti-PD-1 bispecific antibodies. Also provided herein are methods of making and using such antibodies. The antibodies provided advantageously block TGFß activity in a broad population of cells (e.g., active and unactivated hematopoietic cells), and find use wherein such blockage of TGFß activity is desirable, for example, for the treatment of cancers.

In a first aspect, provided herein is a heterodimeric antibody comprising:

a) a first monomer comprising: i) a scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH1-CH1-hinge-CH2-CH3, wherein VH is a first variable heavy domain and CH2-CH3 is a second Fc domain; and c) a light chain comprising, from N-terminus to C-terminus, VL1-CL, wherein VL1 is a variable light domain and CL is a constant light domain. The VH1 and the VL1 together form a first antigen binding domain (ABD). The scFv comprises a second VH domain (VH2), a scFv linker, and a second VL domain (VL2), wherein the VH2 and the VL2 together form a second ABD. Further, one of the first ABD and second ABD is a TGFßRII binding domain and the other of the first ABD and second ABD is a CD5 binding domain. The TGFßRII binding domain comprises a variable heavy domain selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and a variable light domain selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. The CD5 binding domain comprises a variable heavy domain selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and a variable light domain selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141.

In some embodiments, the first ABD is a CD5 binding domain and the second ABD is a TGFßRII binding domain. In exemplary embodiments, the TGFßRII binding domain comprises: a) a variable heavy domain selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and b) a variable light domain selected from the group consisting of: SEQ ID NOs:1867, 1879, and 1606-1703.

In some embodiments, the TGFßRII binding domain comprises a variable heavy domain and a variable light domain selected from the group consisting of: SEQ ID NOs:2389 and 1867, and SEQ ID NOs:2393 and 1867, respectively.

In certain embodiments, the CD5 binding domain comprises: a) a variable heavy domain selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and b) a variable light domain selected from the group consisting of: SEQ ID NO:2175, SEQ ID NO:2167, SEQ ID NO:2191, SEQ ID NOs:1755-1757, SEQ ID NO:2151 and SEQ ID NO:2159. In some embodiments, the CD5 binding domain comprises a variable heavy domain of SEQ ID NO:2187 and a variable light domain of SEQ ID NO:2175.

In some embodiments, the TGFßRII binding domain comprises a variable heavy domain selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and a variable light domain selected from the group consisting of: SEQ ID NOs:1867, 1879, and 1606-1703, and the CD5 binding domain comprises a variable heavy domain selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and a variable light domain selected from the group consisting of: SEQ ID NO:2175, SEQ ID NO:2167, SEQ ID NO:2191, SEQ ID NOs:1755-1757, SEQ ID NO:2151 and SEQ ID NO:2159. In some embodiments, the TGFßRII binding domain comprises a variable heavy domain and variable light domain are selected from the group consisting of: SEQ ID NOs:2389 and 1867, and SEQ ID NOs:2393 and 1867, and the CD5 binding domain comprises a variable heavy domain of SEQ ID NO:2187 and a variable light domain of SEQ ID NO:2175.

In some embodiments, the scFv comprises, from N- to C-terminal, VL2-scFv linker-VH2. In certain embodiments, the scFv comprises, from N- to C-terminal, VH2-scFv linker-VL2.

In some embodiments, the first Fc domain and second Fc domain are each variant Fc domains. In some embodiments, the first and second Fc domains comprise a set of heterodimerization skew variants selected from the following heterodimerization variants: S364K/E357Q:L368D/K370S; S364K:L368D/K370S; S364K:L368E/K370S; D401K:T411E/K360E/Q362E; and T366W:T366S/L368A/Y407V, wherein numbering is according to EU numbering. In exemplary embodiments, the first and second Fc domains comprise heterodimerization skew variants S364K/E357Q:L368D/K370S.

In some embodiments, the first and second Fc domains each comprise one or more ablation variants. In exemplary embodiments, the one or more ablation variants are E233P/L234V/L235A/G236del/S267K, wherein numbering is according to EU numbering.

In some embodiments, the one of the first or second monomer further comprises a pI variant. In exemplary embodiments the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/434S.

In another aspect, provided herein is a heterodimeric antibody comprising: a) a first monomer comprising: i) a scFv comprising a first variable heavy domain, an scFv linker and a first variable light domain; and ii) a first Fc domain, wherein the scFv is covalently attached to the N-terminus of the first Fc domain using a domain linker; b) a second monomer comprising, from N-terminus to C-terminus, a VH1-CH1-hinge-CH2-CH3, wherein VH is a first variable heavy domain and CH2-CH3 is a second Fc domain; and c) a light chain comprising, from N-terminus to C-terminus, VL1-CL, wherein VL1 is a variable light domain and CL is a constant light domain. The VH1 and the VL1 together form a first antigen binding domain (ABD). The scFv comprises a second VH domain (VH2), a scFv linker, and a second VL domain (VL2), wherein the VH2 and the VL2 together form a second ABD. One of the first ABD and second ABD is a TGFßRII binding domain and the other of the first ABD and second ABD is a PD-1 binding domain. The TGFßRII binding domain comprises a variable heavy domain selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and a variable light domain selected from the group consisting of: SEQ ID NOs:1867, 1879, and 1606-1703, and the PD-1 binding domain comprises a variable heavy domain selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, and a variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479.

In some embodiments, the first ABD is a PD-1 binding domain and the second ABD is a TGFßRII binding domain.

In certain embodiments, the PD-1 binding domain comprises: a) a variable heavy domain selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, and b) a variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments, the scFv comprises, from N- to C-terminal, VL2-scFv linker-VH2. In certain embodiments, the scFv comprises, from N- to C-terminal, VH2-scFv linker-VL2.

In some embodiments, the first Fc domain and second Fc domain are each variant Fc domains. In some embodiments, the first and second Fc domains comprise a set of heterodimerization skew variants selected from the following heterodimerization variants: S364K/E357Q:L368D/K370S; S364K:L368D/K370S; S364K:L368E/K370S; D401K: T411E/K360E/Q362E; and T366W:T366S/L368A/Y407V, wherein numbering is according to EU numbering. In exemplary embodiments, the first and second Fc domains comprise heterodimerization skew variants S364K/E357Q: L368D/K370S.

In some embodiments, the first and second Fc domains each comprise one or more ablation variants. In exemplary embodiments, the one or more ablation variants are E233P/L234V/L235A/G236del/S267K, wherein numbering is according to EU numbering.

In some embodiments, the one of the first or second monomer further comprises a pI variant. In exemplary embodiments the CH1-hinge-CH2-CH3 of the second monomer comprises pI variants N208D/Q295E/N384D/Q418E/N421D, wherein numbering is according to EU numbering.

In some embodiments, the CH1-hinge-CH2-CH3 of the second monomer comprises amino acid variants L368D/K370S/N208D/Q295E/N384D/Q418E/N421D/E233P/L234V/L235A/G236del/S267K, and the first Fc domain comprises amino acid variants S364K/E357Q/E233P/L234V/L235A/G236del/S267K, wherein numbering is according to EU numbering.

In exemplary embodiments, the first and second variant Fc domains each comprise amino acid variants 428L/434S.

In another aspect, provided herein is a composition comprising a TGFßRII binding domain comprising: a) a variable heavy domain with an amino acid sequence selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NOs:1859, 1863, 1323-1605; and b) variable light domain with an amino acid sequence selected from the group consisting of: SEQ ID NOs:1867, and 1606-1703. In some embodiments, the composition is an antibody comprising: a) a heavy chain comprising the VH-CH1-hinge-CH2-CH3; and b) a light chain comprising the VL-CL.

In another aspect, provided herein is a composition comprising a CD5 binding domain comprising: a) a variable heavy domain with an amino acid sequence selected from the group consisting of: SEQ ID NO:2155 and SEQ ID NO:2147; and b) variable light domain with an amino acid sequence selected from the group consisting of: SEQ ID NO:2159 and SEQ ID NO:2151. In some embodiments, the composition is an antibody comprising: a) a heavy chain comprising the VH-CH1-hinge-CH2-CH3; and b) a light chain comprising the VL-CL.

In yet another aspect, provided herein is a composition comprising a CD5 binding domain comprising: a) a variable heavy domain with an amino acid sequence selected from the group consisting of: SEQ ID NO:2187, SEQ ID NO:2163, SEQ ID NO:2171, SEQ ID NO:2179, SEQ ID NO:2183, and SEQ ID NO:s1704-1754; and b) variable light domain with an amino acid sequence selected from the group consisting of: SEQ ID NO:2175, SEQ ID NO:2167, SEQ ID NO:2191, and SEQ ID NOs:1755-1757. In some embodiments, the composition is an antibody comprising: a) a heavy chain comprising the VH-CH1-hinge-CH2-CH3; and b) a light chain comprising the VL-CL.b) a light chain comprising the VL-CL.

In another aspect, provided herein is a heterodimeric, bispecific antibody comprising: a) a means for binding TGFßRII attached to a first monomer; b) a means for binding CD5 (or PD-1) attached to a second monomer; and c) a means for heterodimerization of the first monomer and second monomer.

In one aspect, provided herein is a heterodimeric, bispecific antibody comprising: a) a means for binding TGFßRII attached to a first monomer; and b) a means for binding CD5 attached to a second monomer; wherein the first monomer comprises a first variant Fc domain, the second monomer comprises a second variant Fc domain, and the first variant Fc domain and second variant Fc domain comprises heterodimerization skew variants S364K/E357Q:L368D/K370S.

In one aspect, provided herein is a heterodimeric, bispecific antibody comprising: a) a means for binding TGFßRII attached to a first monomer; and b) a means for binding PD-1 attached to a second monomer; wherein the first monomer comprises a first variant Fc domain, the second monomer comprises a second variant Fc domain, and the first variant Fc domain and second variant Fc domain comprises heterodimerization skew variants S364K/E357Q:L368D/K370S.

In another aspect, provided herein is heterodimeric, bispecific antibody comprising: a) a means for binding TGFßRII attached to a first monomer; b) a CD5 binding domain attached to a second monomer, wherein the CD5 binding domain comprises: i) a variable heavy domain selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and ii) a variable light domain selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141; and c) a means for heterodimerization of the first monomer and second monomer. In some embodiments, the variable heavy domain is SEQ ID NO:2187 and the variable light domain is SEQ ID NO:2175.

In one aspect, provided herein is a heterodimeric, bispecific antibody comprising: a) a means for binding CD5 attached to a first monomer; b) a TGFßRII binding domain attached to a second monomer, wherein the TGFßRII binding domain comprises: i) a variable heavy domain selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and ii) a variable light domain selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319; and c) a means for heterodimerization of the first monomer and second monomer. In some embodiments, the variable heavy domain and variable light domain are selected from the group consisting of: SEQ ID NOs:2389 and 1867, and SEQ ID NOs:2393 and 1867, respectively.

In another aspect, provided herein is a heterodimeric, bispecific antibody comprising: a) a means for binding TGFßRII attached to a first monomer; b) a PD-1 binding domain attached to a second monomer, wherein the PD-1 binding domain comprises: i) a variable heavy domain selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, and ii) a variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479; and c) a means for heterodimerization of the first monomer and second monomer. In some embodiments, the variable heavy domain and the variable light domain are selected from the group consisting of: SEQ ID NOs:483 and 979, and SEQ ID NOs:959 and 517, respectively.

In another aspect, provided herein is a bispecific antibody comprising: a) a means for binding PD-1 attached to a first monomer; b) a TGFßRII binding domain attached to a second monomer, wherein the TGFßRII binding domain comprises: i) a variable heavy domain selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and ii) a variable light domain selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319; and c) a means for heterodimerization of the first monomer and second monomer. In some embodiments, the variable heavy domain and variable light domain are selected from the group consisting of: SEQ ID NOs:2389 and 1867, and SEQ ID NOs:2393 and 1867, respectively.

In addition, provided herein are nucleic acid compositions that include nucleic acids encoding components of the subject heterodimeric antibodies (e.g., first and second monomers and light chains) and antigen binding domains provided herein, expression vectors that include the nucleic acid compositions and host cells that include the nucleic acid compositions or expression vectors. Also provided herein is a method of making the subject bispecific heterodimeric antibody by culturing a host cell described herein under conditions wherein the bispecific heterodimeric antibody is produced and recovering the antibody.

In another aspect, provided herein is a method of treating a patient with cancer comprising administering a bispecific heterodimeric as provided herein.

BRIEF DESCRIPTION OF THE DRAWINGS

FIGS. 1A-1E depict useful pairs of Fc heterodimerization variant sets (including skew and pI variants). There are variants for which there are no corresponding "monomer 2" variants; these are pI variants which can be used alone on either monomer. Heterodimer yield (%) and CH3 $T_m$ (° C.) of preferred Fc heterodimerization variants were previously describe (see, e.g., FIG. 8 of U.S. Patent Application No. 2019/0248898).

FIG. 2 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 3 depicts useful ablation variants that ablate FcγR binding (sometimes referred to as "knock outs" or "KO" variants). Generally, ablation variants are found on both monomers, although in some cases they may be on only one monomer.

FIG. 4 depicts particularly useful embodiments of "non-Fv" components of the invention.

FIG. 5 depicts a number of charged scFv linkers that find use in increasing or decreasing the pI of the subject heterodimeric bsAbs that utilize one or more scFv as a component, as described herein. The (+H) positive linker finds particular use herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include scFvs (including but not limited to 1+1 Fab-scFv-Fc, 1+1 Fab-VHH-Fc, 2+1 $Fab_2$-scFv-Fc, 2+1 $Fab_2$-VHH-Fc, etc.).

FIG. 6 depicts a number of exemplary domain linkers. In some embodiments, these linkers find use linking a single-chain Fv or VHH to an Fc chain. In some embodiments, these linkers may be combined in any orientation. For example, a GGGGS linker may be combined with a "lower half hinge" linker at the N-terminus or at the C-terminus.

FIGS. 7A-7D show the sequences of several useful heterodimeric backbones based on human IgG, without the VH, CH1, and hinge sequences. Such backbones can be used with any of the heterodimeric antibodies disclosed herein, including heterodimeric antibodies that include any of the TGFßRII binding domains, PD1 binding domains, and CD5 binding domains disclosed herein, including the figures and sequence listing, and heterodimeric bispecific antibodies disclosed herein (e.g., αTGFßRII×αPD-1 and αTGFßRII×αCD5 bsAb). The backbones can be used in combination with any of TGFßRII binding domains, PD1 binding domains, an/or CD5 binding domains disclosed herein, including the figures and sequence listing. Heterodimeric Fc backbone 1 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants on both chains. Heterodimeric Fc backbone 2 is based on human IgG1 (356E/358M allotype), and includes the L368D/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 3 is based on human IgG1 (356E/358M allotype), and includes the L368E/K370S skew variants and the Q295E/N384D/Q418E/N421D pI variants on a first heterodimeric Fc chain, the S364K skew variant on a second heterodimeric Fc chain, and the E233P/L234V/L235A/G236del/S267K ablation variants on both chains. Heterodimeric Fc backbone 4 is based on human IgG1 (356E/358M allotype), and includes the K360E/Q362E/T411E skew variants and the Q295E/N384D/Q418E/N421D pI variants on a first heterodimeric Fc chain, the D401K skew variant on a second heterodimeric Fc chain, and the E233P/L234V/L235A/G236del/S267K ablation variants on both chains. Heterodimeric Fc backbone 5 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants on both chains. Heterodimeric Fc backbone 6 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297A variant that removes glycosylation on both chains. Heterodimeric Fc backbone 7 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and N297S variant that removes glycosylation on both chains. Heterodimeric Fc backbone 8 is based on human IgG4, and includes the L368D/K370S skew variants and the Q295E/N384D/Q418E/N421D pI variants on a first heterodimeric Fc chain, the S364K/E357Q skew variants on a second heterodimeric Fc chain, and the S228P (according to EU numbering, S241P in Kabat) variant that ablates Fab arm exchange (as is known in the art) on both chains. Heterodimeric Fc backbone 9 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain. Heterodimeric Fc backbone 10 is based on human IgG2, and includes the L368D/K370S skew variants and the Q295E/N384D/Q418E/N421D pI variants on a first heterodimeric Fc chain, the S364K/E357Q skew variants on a second heterodimeric Fc chain, and the S267K ablation variant on both chains. Heterodimeric Fc backbone 11 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434S Xtend variants on both chains. Heterodimeric Fc backbone 12 is based on human IgG1 (356E/358M allotype), and includes the L368D/K370S skew variants on a first heterodimeric Fc chain, the S364K/E357Q skew variants and P217R/P229R/N276K pI variants on a second heterodimeric Fc chain, and the E233P/L234V/L235A/G236del/S267K ablation variants on both chains. Heterodimeric Fc backbone 13 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434S Xtend variants on both chains. Heterodimeric Fc backbone 14 is based on human IgG1 (356E/358M allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434A Xtend variants on both chains. Heterodimeric Fc backbone 15 is based on human IgG1 (356D/358L allotype), and includes the L368D/K370S skew variants and the Q295E/N384D/Q418E/N421D pI variants on a first heterodimeric Fc chain, the S364K/E357Q skew variants on a second heterodimeric Fc chain, and the E233P/L234V/L235A/G236del/S267K ablation variants and M428L/N434A Xtend variants on both chains.

Figure 14:
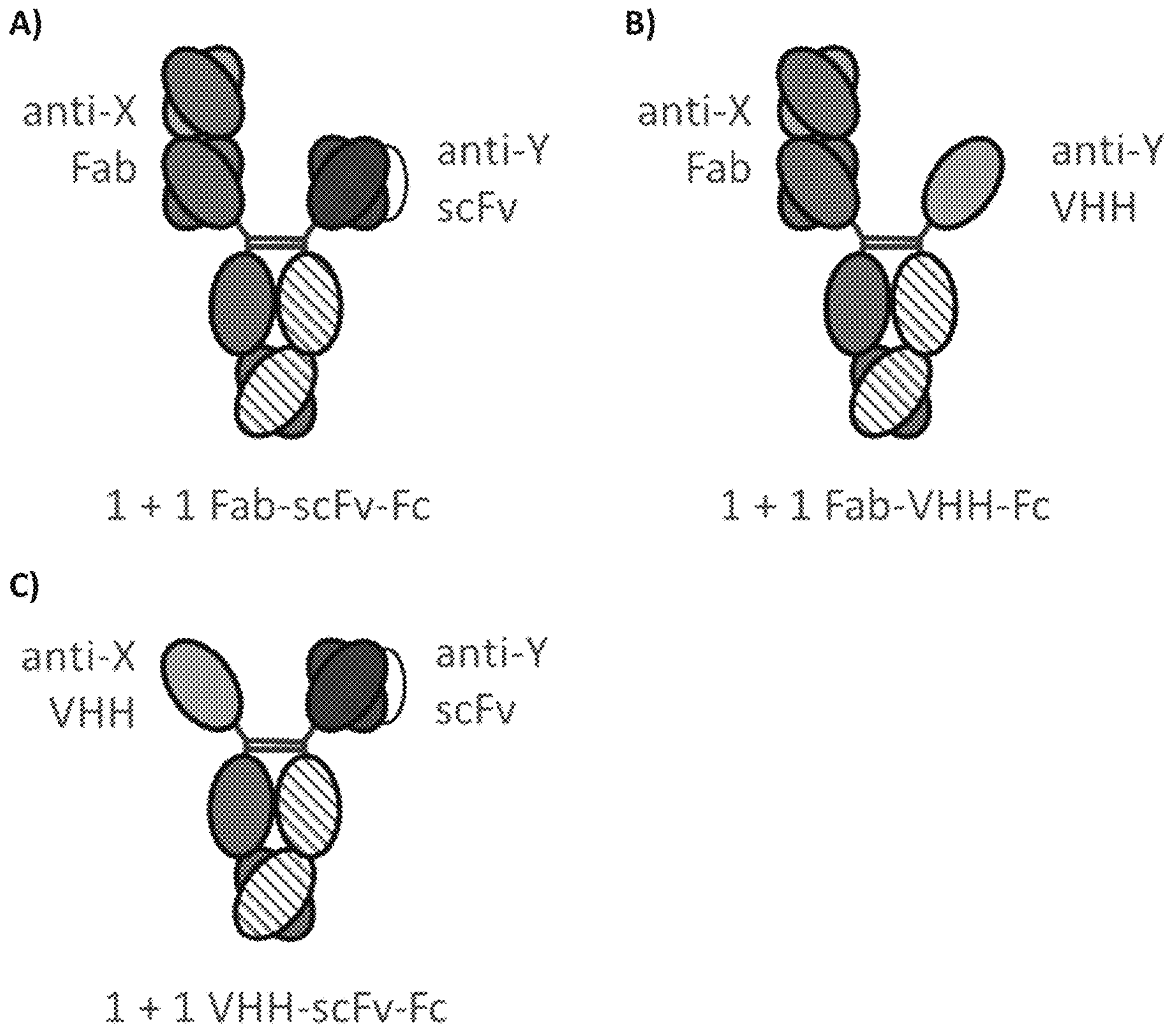

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition or as an alternative to the skew, pI and ablation variants contained within the backbones of this Figure.

FIG. 8 depicts sequences for "CH1+hinge" that find use in embodiments of the antibodies disclosed herein that utilize a Fab binding domain. Such sequences can be used, for example with any of the heterodimeric antibodies disclosed herein that utilize a Fab binding domain, including heterodimeric antibodies that include any of the TGFßRII binding domains, PD1 binding domains, and CD5 binding domains disclosed herein, including the figures and sequence listing, and heterodimeric bispecific antibodies disclosed herein (e.g., αTGFßRII×αPD-1 and αTGFßRII×αCD5 bsAb). The CH1+ hinge sequences can be used in combination with any of the TGFßRII binding domains, PD1 binding domains, an/or CD5 binding domains disclosed herein, including the figures and sequence listing. The "CH1+ hinge" sequences find use linking the variable heavy domain ($V_H$) to the Fc backbones (as depicted in FIG. 39). For particular embodiments wherein the Fab is on the (+) side, the "CH1(+)+ hinge" sequences may find use. For particular embodiments wherein the Fab is on the (−) side, the "CH1(−)+ hinge" sequences may find use.

FIG. 9 depicts sequences for "CH1+ half hinge" domain linker that find use in embodiments of the heterodimeric bispecific antibodies disclosed herein (e.g., αTGFßRII×αPD-1 and αTGFßRII×αCD5 bsAbs) of the higher valency formats, including but not limited to the 2+1 $Fab_2$-scFv-Fc format and 2+1 $Fab_2$-VHH-Fc format. The "CH1+ half hinge" sequences find use linking the variable heavy domain ($V_H$) to the scFv domain on the Fab-scFv-Fc side of the bispecific antibody or the VH to the VHH domain on the Fab-VHH-Fc side. It should be noted that other linkers may be used in place of the "CH1+upper half hinge". The CH1+half hinge sequences can be used in combination with any of the TGFßRII binding domains, PD1 binding domains, an/or CD5 binding domains disclosed herein, including those disclosed in the figures and sequence listing.

FIG. 10 depicts sequences for "CH1" that find use in embodiments of the heterodimeric bispecific antibodies disclosed herein (e.g., αTGFßRII×αPD-1 and αTGFßRII×αCD5 bsAbs). These sequences can be used in combination with any of the TGFßRII binding domains, PD1 binding domains, an/or CD5 binding domains disclosed herein, including those disclosed in the figures and sequence listing.

FIG. 11 depicts sequences for "hinge" that find use in embodiments of the heterodimeric bispecific antibodies disclosed herein (e.g., αTGFßRII×αPD-1 and αTGFßRII×αCD5 bsAbs). These sequences can be used in combination with any of the TGFßRII binding domains, PD1 binding domains, an/or CD5 binding domains disclosed herein, including those disclosed in the figures and sequence listing.

FIG. 12 depicts the sequences of several useful constant light domain backbones based on human IgG1, without the Fv sequences (e.g. the scFv or the Fab). Included herein are constant light backbone sequences that are 90, 95, 98 and 99% identical (as defined herein) to the recited sequences, and/or contain from 1, 2, 3, 4, 5, 6, 7, 8, 9 or 10 additional amino acid modifications. These sequences can be used in combination with any of the TGFßRII binding domains, PD1 binding domains, an/or CD5 binding domains disclosed herein, including those disclosed in the figures and sequence listing.

FIG. 13 depicts the sequences for XENP16432, an anti-PD-1 mAb based on nivolumab and IgG1 backbone with E233P/L234V/L235A/G236del/S267K ablation variant. CDRs are underlined and slashes indicate the border(s) between the variable regions and constant domain.

FIG. 14 depicts 1+1 bispecific formats of the present invention. FIG. 14A depicts the "1+1 Fab-scFv-Fc" format, with a first Fab arm binding a first antigen X and a second scFv arm binding a second antigen Y. The 1+1 Fab-scFv-Fc format comprises a first monomer comprising a first heavy chain variable region (VH1) covalently attached to the N-terminus of a first heterodimeric Fc backbone (optionally via a linker), a second monomer comprising an scFv covalently attached to the N-terminus of a second corresponding heterodimeric Fc backbone (optionally via a linker), and a third monomer comprising a light chain variable region (VL) covalently attached to a light chain constant domain, wherein the VL is complementary to the VH1. FIG. 14B depicts the "1+1 Fab-VHH-Fc" format, with a with a first Fab arm binding a first antigen X and a second VHH arm binding a second antigen Y. The 1+1 Fab-VHH-Fc format comprises a first monomer comprising a first heavy chain variable region (VH1) covalently attached to the N-terminus of a first heterodimeric Fc backbone (optionally via a linker), a second monomer comprising a VHH covalently attached to the N-terminus of a second corresponding heterodimeric Fc backbone (optionally via a linker), and a third monomer comprising a light chain variable region (VL) covalently attached to a light chain constant domain, wherein the VL is complementary to the VH1. FIG. 14C depicts the "1+1 VHH-scFv-Fc" format, with a first VHH arm binding a first antigen X and a second scFv arm binding a second antigen Y. The 1+1 VHH-scFv-Fc format comprises a first monomer comprising a VHH covalently attached to the N-terminus of a first heterodimeric Fc backbone (optionally via a linker) and a second monomer comprising a single-chain Fv (scFv) covalently attached to the N-terminus of a second corresponding heterodimeric Fc backbone (optionally via a linker). A single-chain Fv or scFv is a heavy chain variable region covalently linked to a corresponding light chain region to form an antigen binding domain. As used herein, a VHH is the antigen binding domain of heavy chain only antibodies, a VHH is the heavy chain variable region of heavy chain only antibodies. X may be TGFßRII and Y may be PD1 or CD5, and vice versa.

Figure 15:
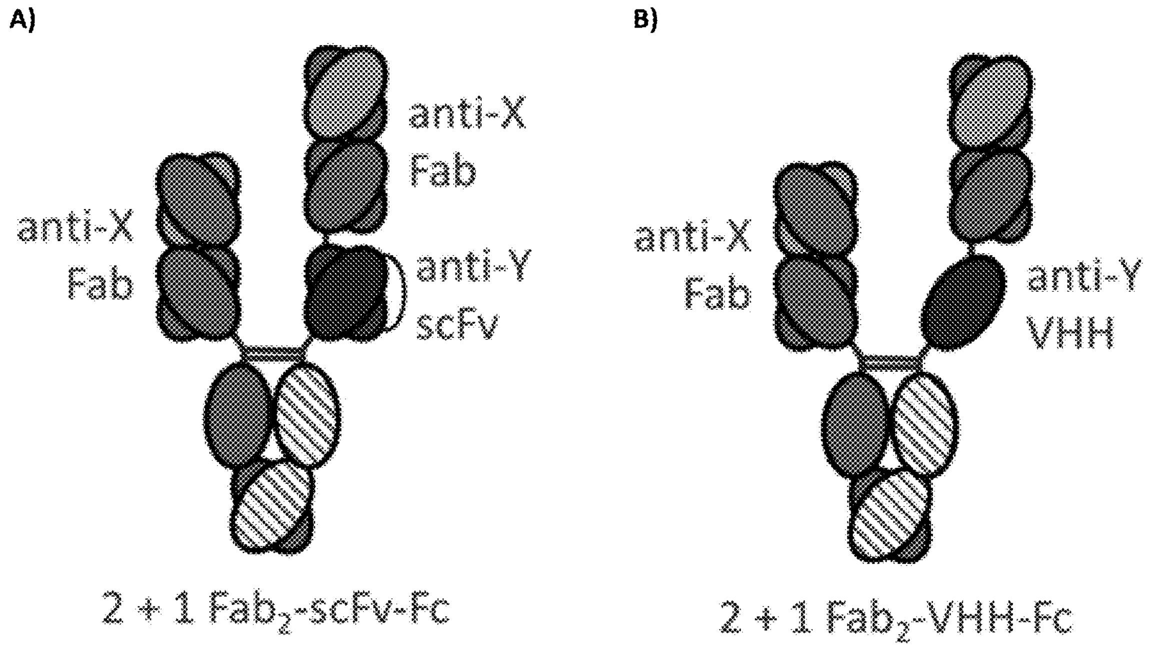
Figure 16A:
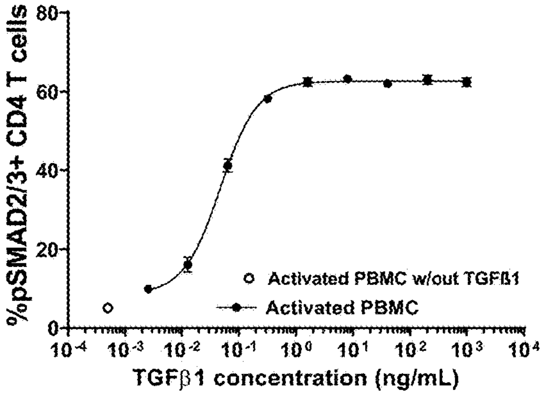
Figure 16B:
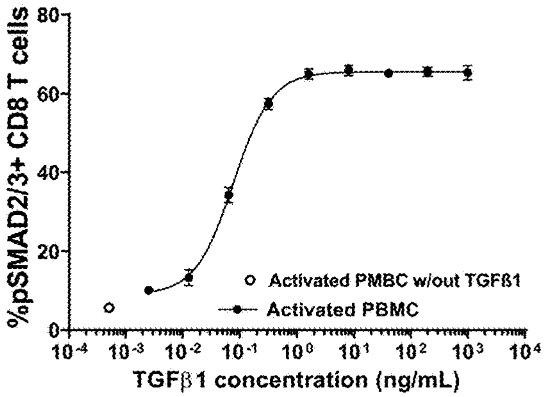
Figure 16C:
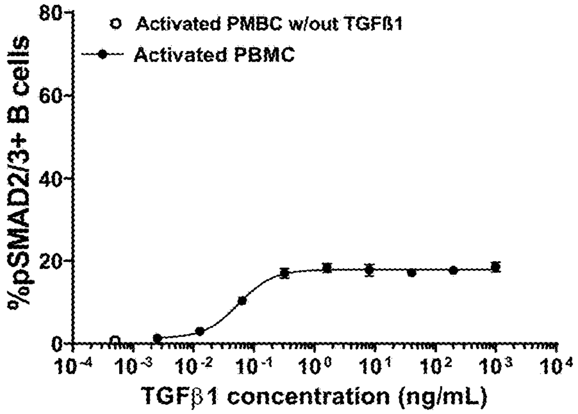
Figure 16D:
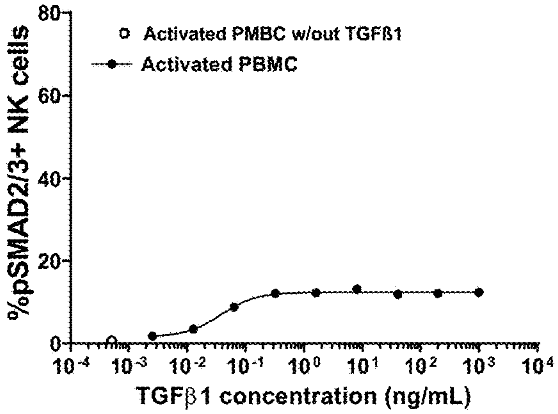

FIG. 15 depicts illustrative higher valency formats, in particular 2+1 bispecific formats, of the present invention. FIG. 15A depicts the "2+1 $Fab_2$-scFv-Fc" format, with a first Fab arm binding a first antigen X and a second Fab-scFv arm, wherein the Fab binds first antigen X and the scFv binds a second antigen Y. The 2+1 $Fab_2$-scFv-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a single-chain Fv covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. FIG. 15B depicts the "2+1 $Fab_2$-VHH-Fc" format, with a first Fab arm binding a first antigen X and a second Fab-VHH arm, wherein the Fab binds first antigen X and the VHH binds a second antigen Y. The 2+1 $Fab_2$-VHH-Fc format comprises a first monomer comprising a first heavy chain variable region (VH1) covalently attached to the N-terminus of a first heterodimeric Fc backbone (optionally via a linker), a second monomer comprising the VH1 covalently attached (optionally via a linker) to a VHH covalently attached (optionally via a linker) to the N-terminus of a second corresponding heterodimeric Fc backbone, and a third monomer comprising a light chain variable region covalently to a light chain constant domain, wherein the light chain variable region is complementary to the VH1. A single-chain Fv or scFv is a heavy chain variable region covalently linked to a corresponding light chain region to form an antigen binding domain. As used herein, a VHH is the antigen binding domain of heavy chain only antibodies. X may be TGFßRII and Y may be PD1 or CD5, and vice versa.

FIGS. 16A-16D depict the induction of SMAD2/3 phosphorylation on A) $CD4^+$ T cells, B) $CD8^+$ T cells, C) B cells, and D) NK cells by soluble TGFß1. The data show that TGFß1 dose dependently induces phosphorylation of SMAD2/3 on $CD4^+$ and $CD8^+$ T cells, and limited phosphorylation of SMAD2/3 on B cells and NK cells.

Figure 17A:
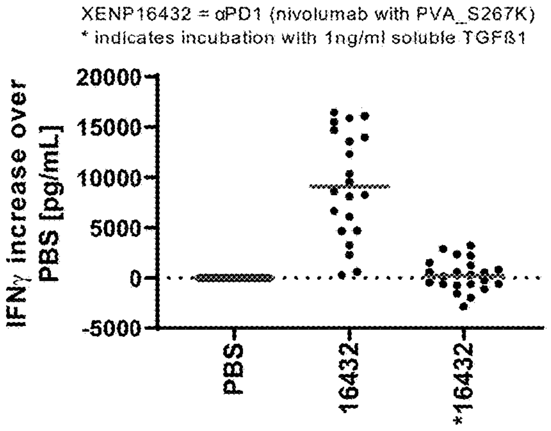
Figure 17B:
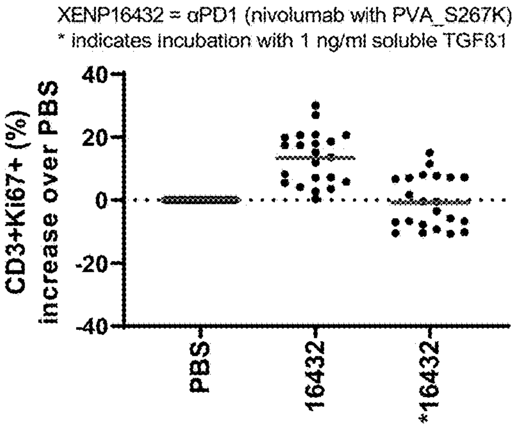
Figure 17C:
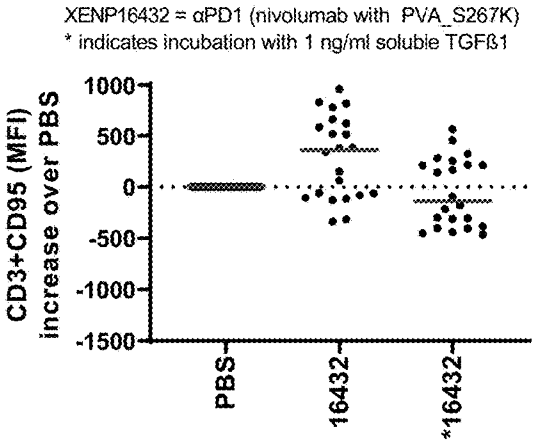

FIGS. 17A-17C depict A) the induction of IFNγ release, B) $CD3^+$ T cell proliferation as indicated by percentage CD3+Ki67+ T cells, and C) CD95 expression on $CD3^+$ T cells in mixed lymphocyte reactions following incubation with XENP16432 (PD-1 blockade mAb based on nivolumab with PVA_S267K) in the absence or presence of 1 ng/ml soluble TGFß1 (as indicated by *). The data show that PD-1 blockade enhances IFNγ secretion, $CD3^+$ T cell proliferation, and CD95 expression; but, the presence of TGFß1 suppresses this effect.

FIG. 18 depicts the sequences for TGFßRII for both human and cynomolgus monkey to facilitate the development of antigen binding domains that bind to both for ease of clinical development.

FIGS. 19A and 19B depict the variable heavy and variable light chains for illustrative anti-TGFßRII ABDs which find use in the anti-TGFßRII×anti-PD1 bispecific antibodies of the invention. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems.

FIG. 20 depicts the sequences for illustrative anti-TGFßRII antibodies. It is important to note that these sequences were generated based on human IgG1, with an ablation variant (E233P/L234V/L235A/G236del/S267K, "IgG1_PVA_/S267K"). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems.

Figure 21:
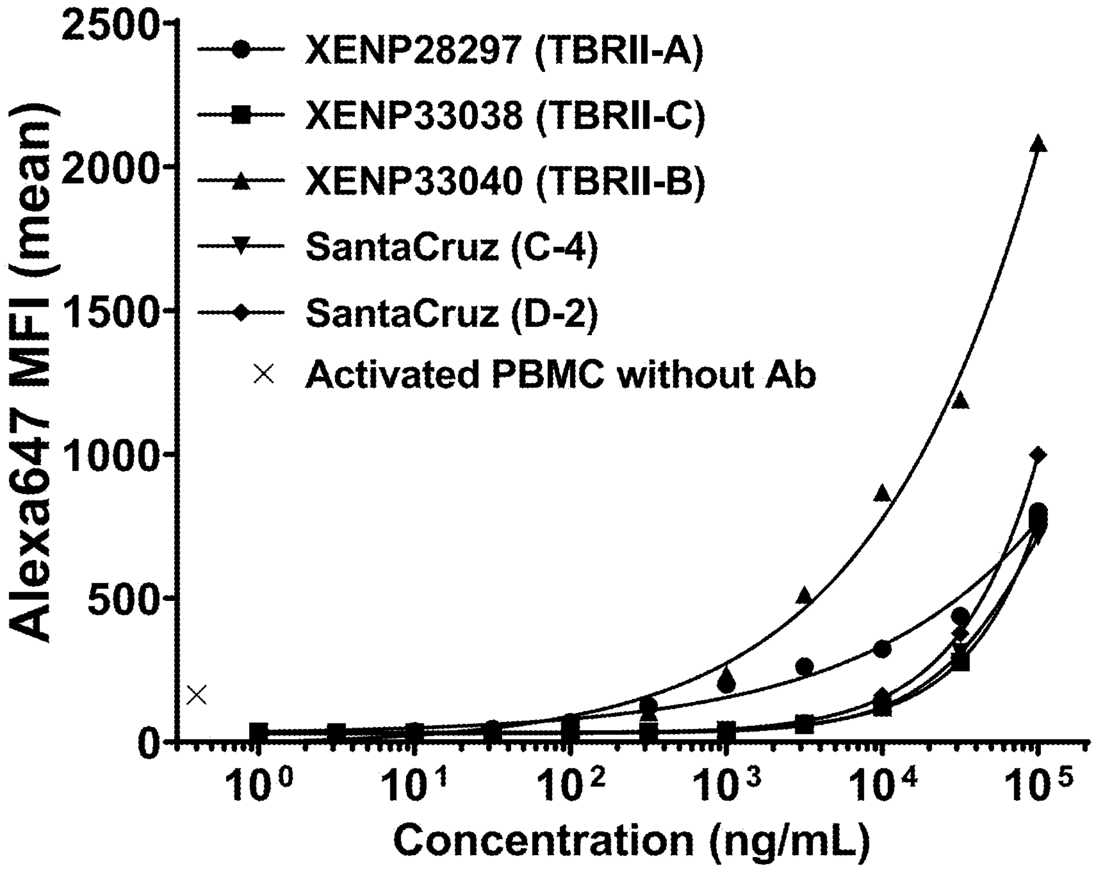

FIG. 21 depicts the dose dependent binding of various anti-TGFßRII antibodies to stimulated human PBMCs.

FIG. 22 depicts the antigen sequences for PD-1 for both human and cynomolgus monkey to facilitate the development of antigen binding domains that bind to both for ease of clinical development.

FIG. 23 depicts epitope binning of a bivalent anti-PD-1 mAb based on nivolumab, in-house produced pembrolizumab, chimeric mAb A, chimeric mAb B, and chimeric mAb C as indicated by normalized BLI-response Octet. Normalized BLI-response greater than 0.5 indicate that an antibody pair does not bin to the same epitope.

FIGS. 24A-24AA depict sequences for illustrative anti-TGFßRII×anti-PD1 bsAbs in the "1+1 Fab-scFv-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the anti-TGFßRII×anti-PD1 bsAbs of the invention.

FIG. 25 depicts sequences for illustrative anti-TGFßRII×anti-PD1 bsAbs in the "1+1 Fab-VHH-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the $V_H$ and $V_L$ domains using other numbering systems. As will be appreciated by those in the art, the $V_H$ and $V_L$ (where applicable) domains can be formatted as Fab or scFvs for use in the anti-TGFßRII×anti-PD1 bsAbs of the invention.

FIG. 26 depicts sequences for illustrative anti-TGFßRII×anti-PD1 bsAbs in the "1+1 VHH-scFv-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the $V_H$ and $V_L$ domains using other numbering systems. As will be appreciated by those in the art, the $V_H$ and $V_L$ (where applicable) domains can be formatted as Fab or scFvs for use in the anti-TGFßRII×anti-PD1 bsAbs of the invention.

FIGS. 27A-27L depict sequences for control anti-TGFßRII×anti-RSV bsAbs. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the $V_H$ and $V_L$ domains using other numbering systems. As will be appreciated by those in the art, the $V_H$ and $V_L$ (where applicable) domains can be formatted as Fab or scFvs for use in the anti-RSV×anti-PD1 bsAbs.

Figure 28A:
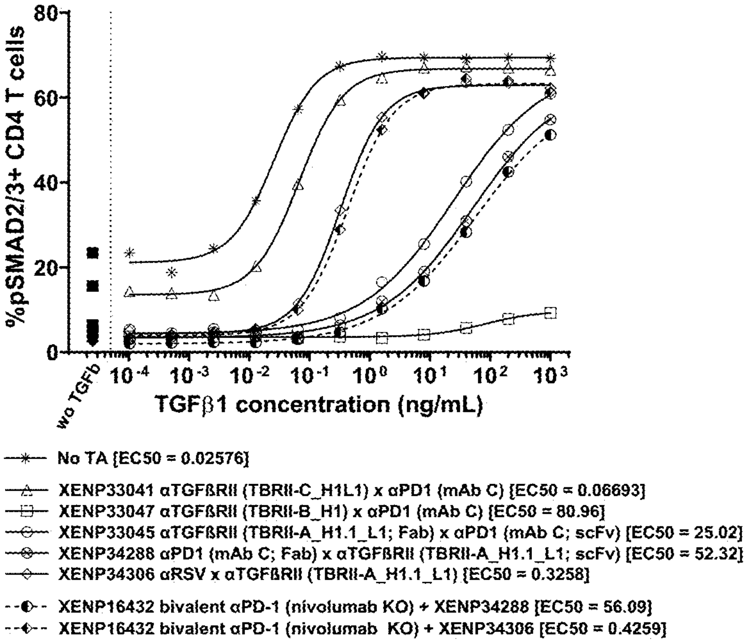
Figure 28B:
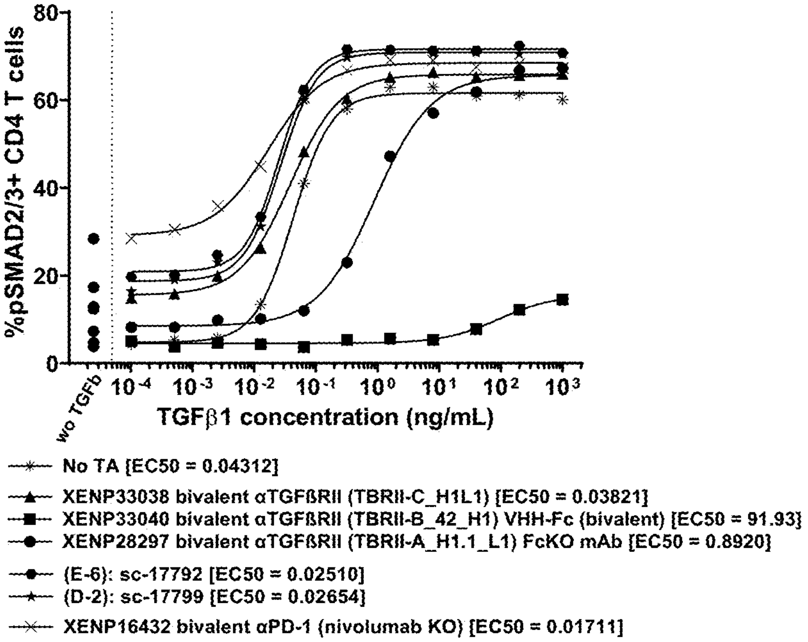

FIGS. 28A and 28B depict the suppression of TGFß1-induced SMAD2/3 phosphorylation by A) bispecific anti-TGFßRII antibodies and B) monospecific anti-TGFßRII antibodies in $CD4^+$ T cells. Reduced potency (i.e. larger EC50 values) TGFß1-induced SMAD2/3 phosphorylation indicates TGFßRII-blockade by the test articles. The data show that the anti-TGFßRII×anti-PD1 bsAbs blocked TGFß1 activity as indicated by decreased potency of TGFß1 in inducing SMAD2/3 phosphorylation following incubation with the bsAbs. The anti-TGFßRII×anti-PD1 bsAbs having anti-TGFßRII arms based on TBRII-A and TBRII-B show superior blocking of TGFß1-induced SMAD2/3 phosphorylation on $CD4^+$ and $CD8^+$ T cells compared to corresponding anti-TGFßRII mAbs and anti-TGFßRII×anti-RSV bsAbs. The TGFßRII binding domain TBRII-C was unable to block TGFß1-induced SMAD2/3 phosphorylation both in the context of a bivalent mAb and in the context of an anti-TGFßRII×anti-PD1 bsAb.

FIGS. 29 and 29B depict the suppression of TGFß1-induced SMAD2/3 phosphorylation by A) bispecific anti-TGFßRII antibodies and B) monospecific anti-TGFßRII antibodies in $CD8^+$ T cells. Reduced potency (i.e. larger EC50 values) TGFß1-induced SMAD2/3 phosphorylation indicates TGFßRII-blockade by the test articles. The data show that the anti-TGFßRII×anti-PD1 bsAbs blocked TGFß1 activity as indicated by decreased potency of TGFß1 in inducing SMAD2/3 phosphorylation following incubation with the bsAbs. The anti-TGFßRII×anti-PD1 bsAbs having anti-TGFßRII arms based on TBRII-A and TBRII-B show superior blocking of TGFß1-induced SMAD2/3 phosphorylation on $CD4^+$ and $CD8^+$ T cells compared to corresponding anti-TGFßRII mAbs and anti-TGFßRII×anti-RSV bsAbs. The TGFßRII binding domain TBRII-C was unable to block TGFß1-induced SMAD2/3 phosphorylation both in the context of a bivalent mAb and in the context of an anti-TGFßRII×anti-PD1 bsAb.

Figure 30A:
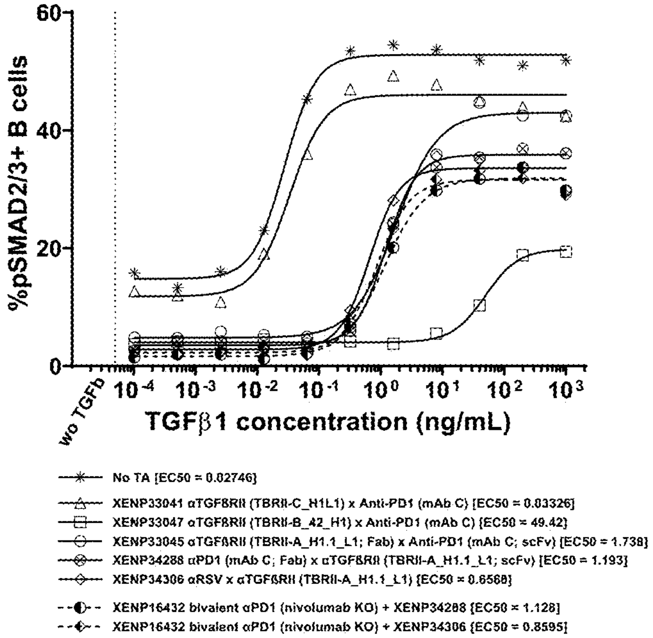
Figure 30B:
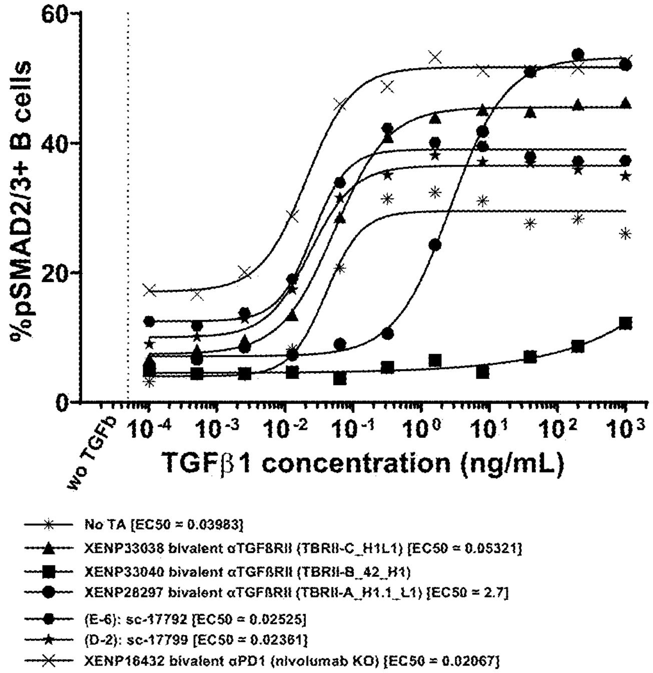

FIGS. 30A and 30B depict the suppression of TGFß1-induced SMAD2/3 phosphorylation by A) bispecific anti-TGFßRII antibodies and B) monospecific anti-TGFßRII antibodies in B cells. Reduced potency (i.e. larger EC50 values) TGFß1-induced SMAD2/3 phosphorylation indicates TGFßRII-blockade by the test articles.

Figure 31A:
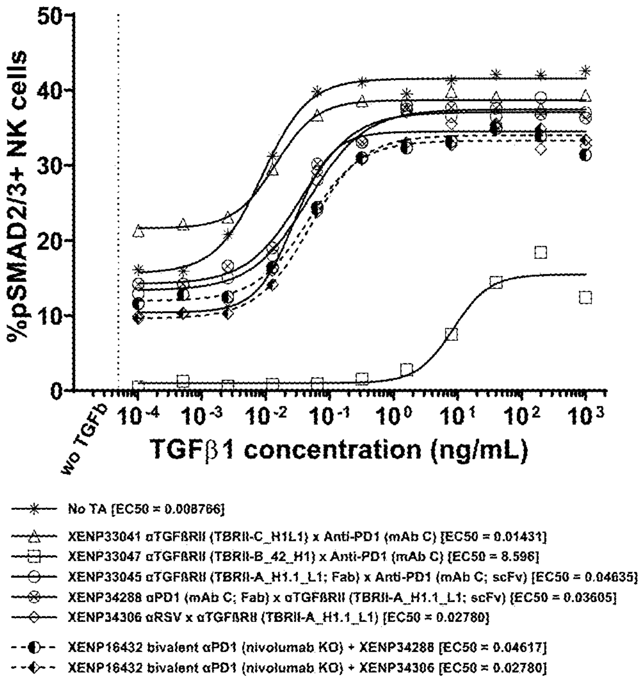
Figure 31B:
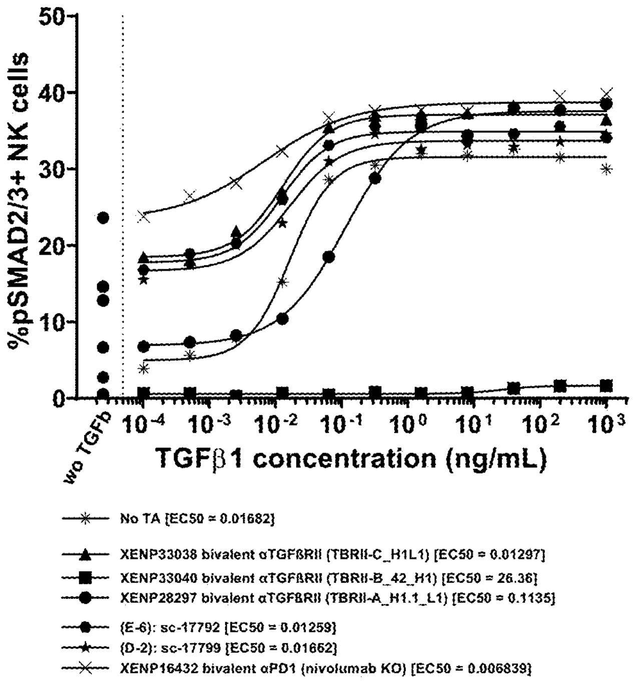

FIGS. 31A and 31B depict the suppression of TGFß1-induced SMAD2/3 phosphorylation by A) bispecific anti-TGFßRII antibodies and B) monospecific anti-TGFßRII antibodies in NK cells. Reduced potency (i.e. larger EC50 values) TGFß1-induced SMAD2/3 phosphorylation indicates TGFßRII-blockade by the test articles.

FIGS. 32A and 32B depict the suppression of TGFß1-induced SMAD2/3 phosphorylation by bispecific anti-TGFßRII antibodies in A) $CD8^+$ T cells and B) $CD4^+$ T cells. The data show that the anti-TGFßRII×anti-PD1 bsAbs dose dependently blocks TGFß1-induced SMAD2/3 phosphorylation. The αPD1 bispecifics show superior blocking compared to αRSV bispecifics. In comparing the activity of XENP34287 and XENP34288 with XENP33045, it appears that using a Fab domain for PD-1 targeting enhances the potency of the anti-TGFßRII×anti-PD1 bsAbs.

Figure 33:
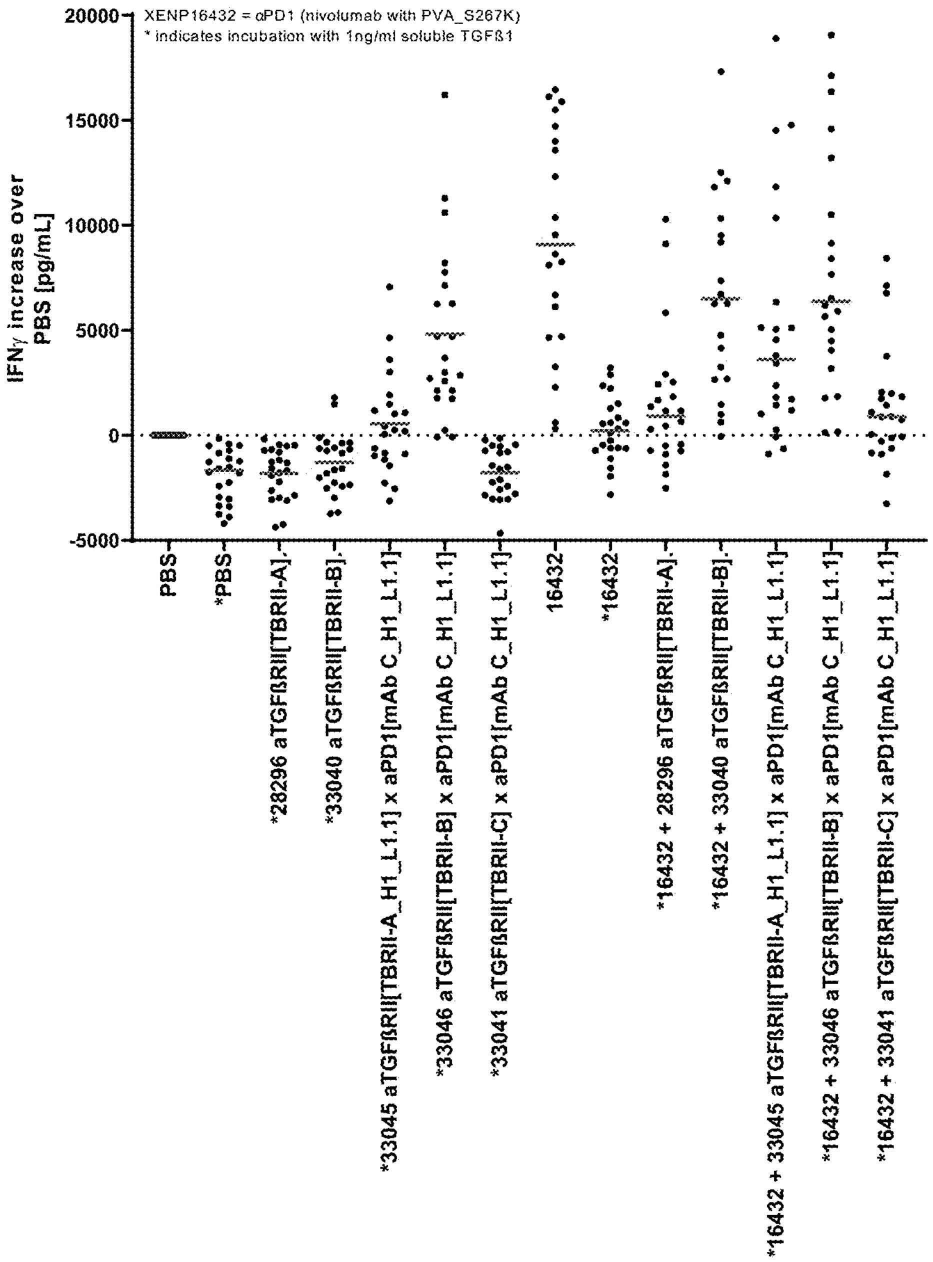

FIG. 33 depicts the induction of IFNγ release in mixed lymphocyte reactions following incubation with bispecific anti-TGFßRII antibodies and monospecific anti-TGFßRII antibodies alone or in combination with XENP16432 (PD-1 blockade mAb based on nivolumab with PVA_S267K) in the absence or presence of 1 ng/ml soluble TGFß1 (as indicated by *). The data show that the anti-TGFßRII×anti-PD1 bsAbs blocked the suppressive effect of TGFß1 and that the anti-TGFßRII×anti-PD1 bsAbs having anti-TGFßRII arms based on TBRII-A and TBRII-B show superior blocking of TGFß1-induced suppression compared to corresponding anti-TGFßRII mAbs. The data shows that XENP33045 and XENP33046 respectively in combination with XENP16432 enhanced IFNγ secretion in comparison to XENP33045 or XENP33046 alone.

Figure 34:
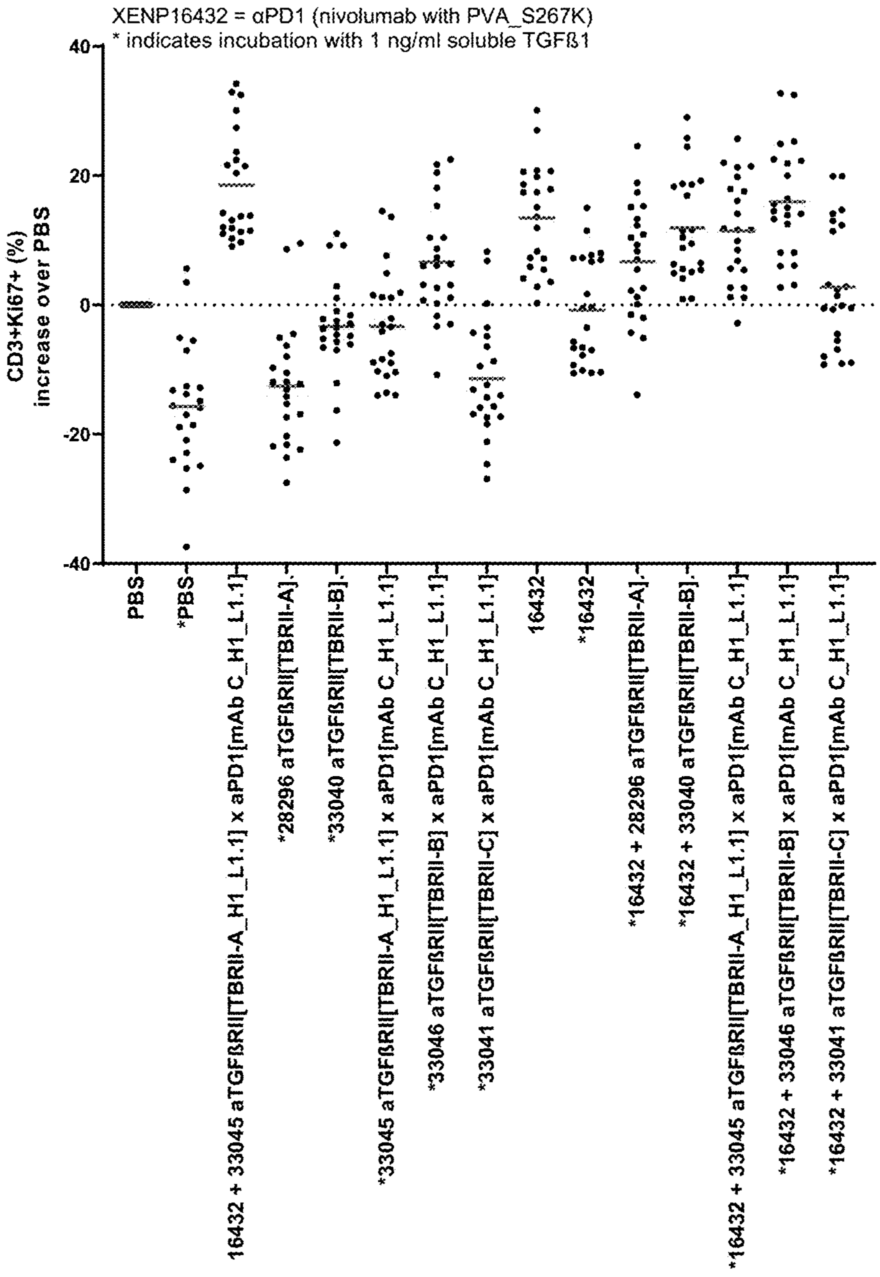

FIG. 34 depicts $CD3^+$ T cell proliferation as indicated by percentage CD3+Ki67+ T cells in mixed lymphocyte reactions following incubation with bispecific anti-TGFßRII antibodies and monospecific anti-TGFßRII antibodies alone or in combination with XENP16432 (PD-1 blockade mAb based on nivolumab with PVA_S267K) in the absence or presence of 1 ng/ml soluble TGFß1 (as indicated by *). The data show that the anti-TGFßRII×anti-PD1 bsAbs blocked the suppressive effect of TGFß1 and that the anti-TGFßRII×anti-PD1 bsAbs having anti-TGFßRII arms based on TBRII-A and TBRII-B show superior blocking of TGFß1-induced suppression compared to corresponding anti-TGFßRII mAbs. The data shows that XENP33045 and XENP33046 respectively in combination with XENP16432 enhanced T cell proliferation in comparison to XENP33045 or XENP33046 alone.

Figure 35:
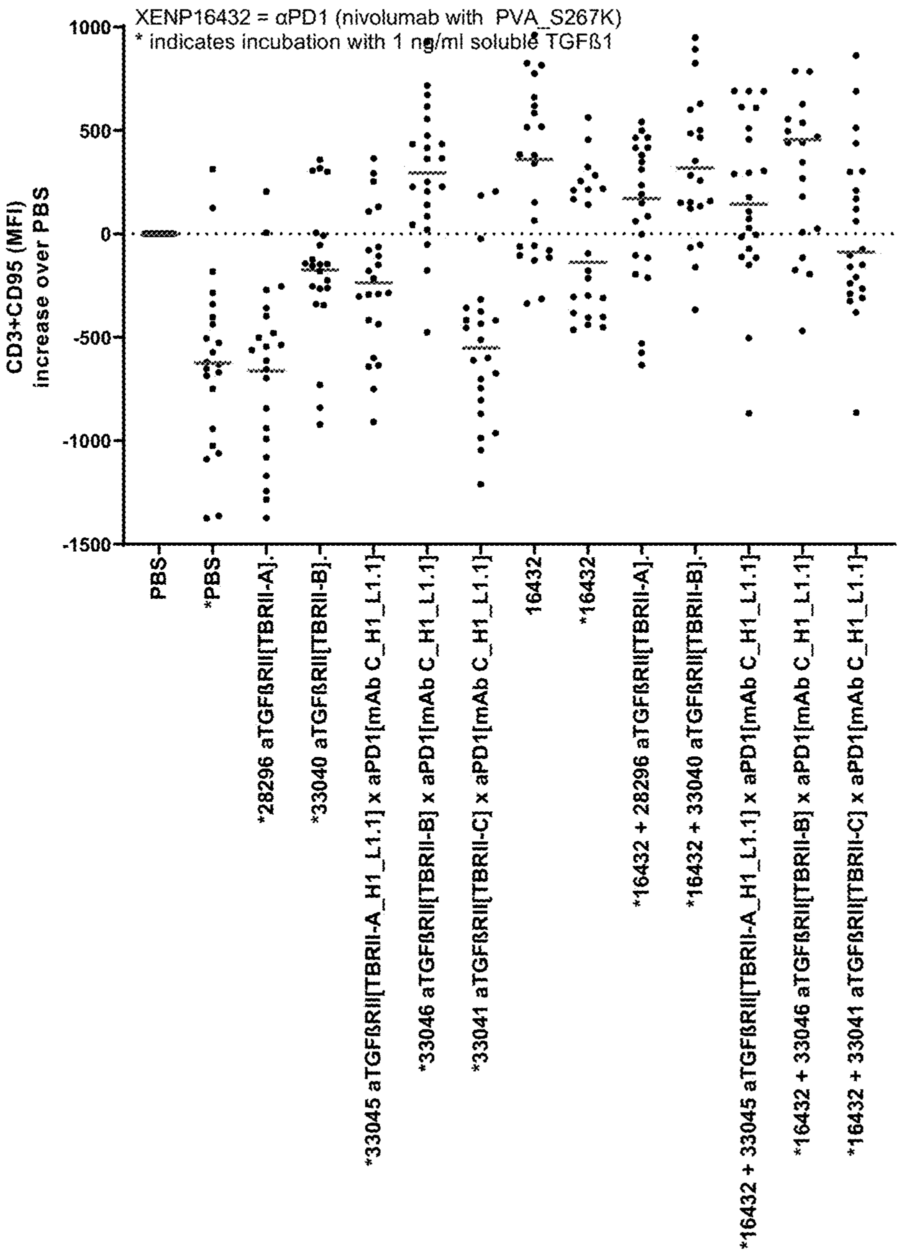

FIG. 35 depicts CD95 expression on $CD3^+$ T cells in mixed lymphocyte reactions following incubation with bispecific anti-TGFßRII antibodies and monospecific anti-TGFßRII antibodies alone or in combination with XENP16432 (PD-1 blockade mAb based on nivolumab with PVA_S267K) in the absence or presence of 1 ng/ml soluble TGFß1 (as indicated by *). The data show that the anti-TGFßRII×anti-PD1 bsAbs blocked the suppressive effect of TGFß1 and that the anti-TGFßRII×anti-PD1 bsAbs having anti-TGFßRII arms based on TBRII-A and TBRII-B show superior blocking of TGFß1-induced suppression compared to corresponding anti-TGFßRII mAbs. The data shows that XENP33045 and XENP33046 respectively in combination with XENP16432 enhanced CD95 expression on T cells in comparison to XENP33045 or XENP33046 alone.

Figure 36A:
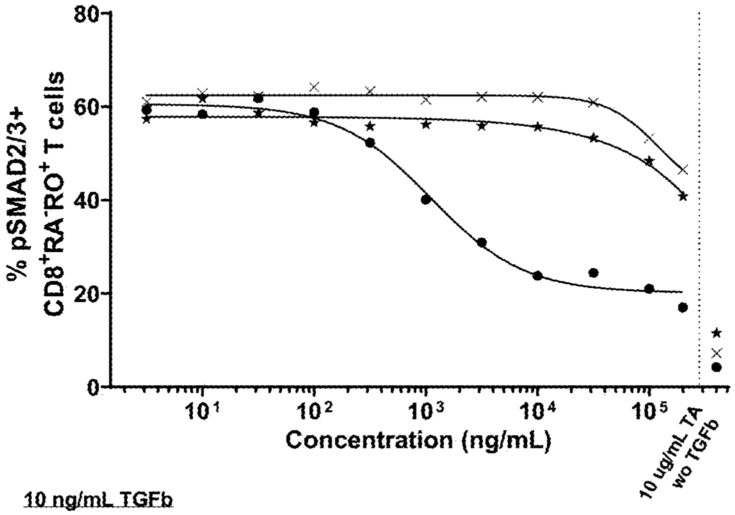
Figure 36B:
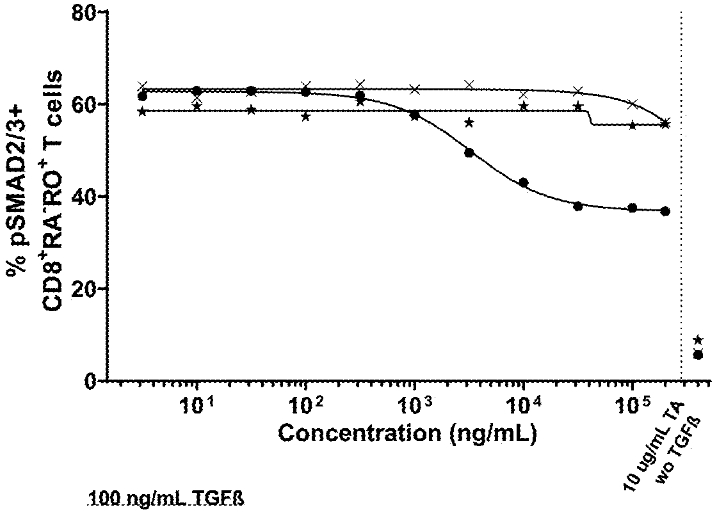

FIGS. 36A and 36B depict the suppression of TGFß1-induced SMAD2/3 phosphorylation on $CD8^+$ T cells by bispecific anti-TGFßRII×anti-PD1 bsAbs in comparison to monospecific anti-TGFßRII mAbs in the presence of A) 10 ng/ml TGFß1 or B) 100 ng/ml TGFß1. The data show that high 10 ng/ml and 100 ng/ml concentrations of TGFß1, anti-TGFßRII×anti-PD1 bsAb based on TBRII-A is more effective at blockade than corresponding monospecific anti-TGFßRII mAb based on TBRII-A.

Figure 37A:
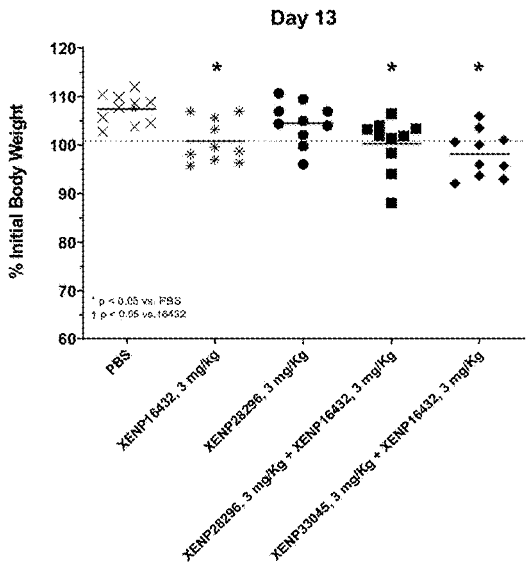
Figure 37B:
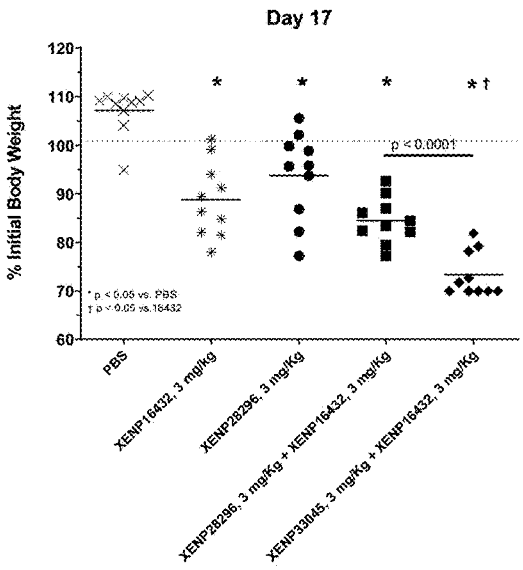
Figure 37C:
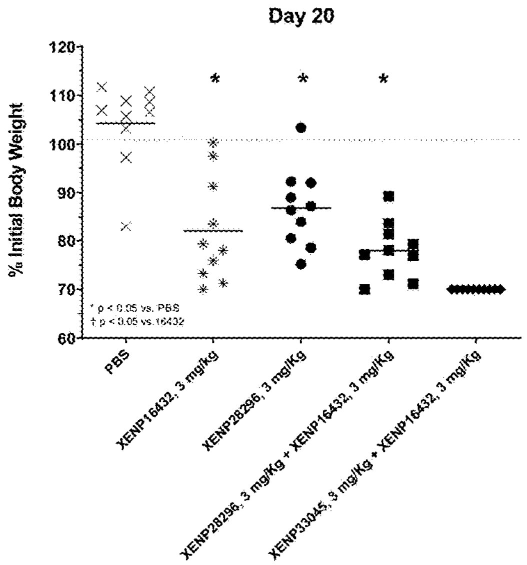
Figure 37D:
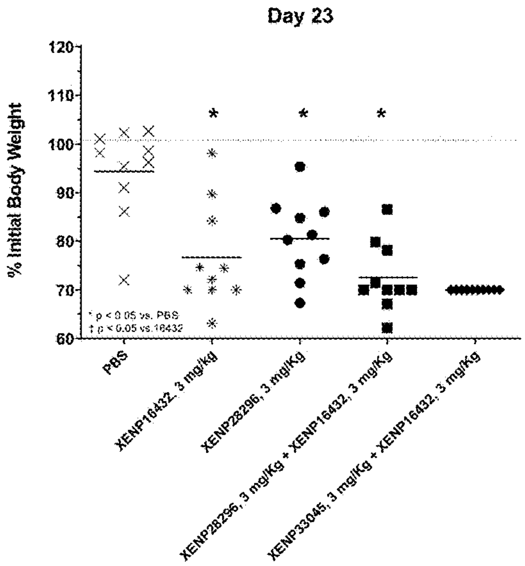
Figure 37E:
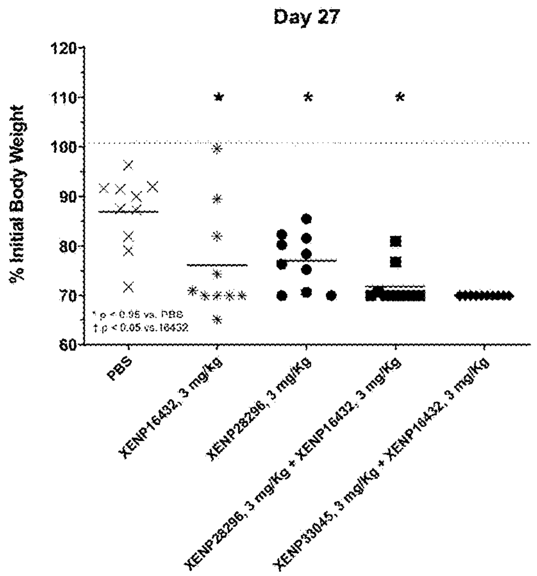
Figure 37F:
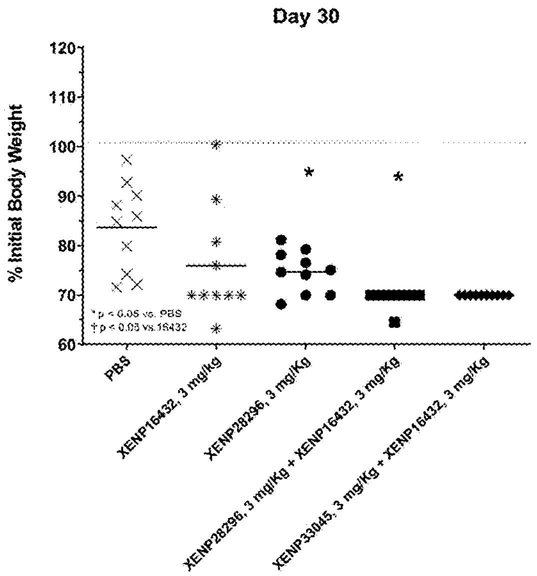
Figure 37G:
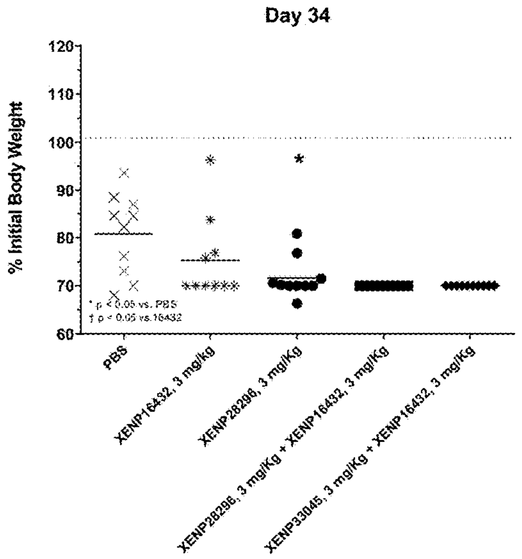
Figure 37H:
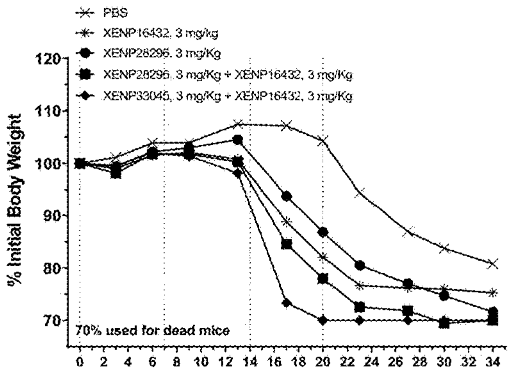

FIGS. 37A and 37H depict the change in body weight (relative to initial body weight) on Days A) 13, B) 17, C) 20, D) 23, E) 27, F) 30, and G) 34, as well as H) the change in body weight over time in huPBMC-engrafted NSG mice dosed with PBS control, XENP16432 anti-PD1 mAb (based on nivolumab with PVA_S267K), XENP28296 bivalent anti-TGFßRII mAb based on TBRII-A, XENP28296 in combination with XENP16432, and XENP33045 anti-TGFßRII×anti-PD1 bsAb based on TBRII-A in combination with XENP16432. The data show that both XENP28296 in combination with PD-1 blockade and XENP33045 in combination with PD-1 blockade significantly enhanced body weight loss by Day 13 in comparison to no treatment (i.e. PBS). By Day 17, XENP33045 in combination with PD-1 blockade significantly enhanced body weight loss in comparison to both PD-1 blockade alone as well as XENP28296 in combination with PD-1 blockade; and by Day 20, all mice treated with XENP33045 in combination with PD-1 blockade were dead. Statistics were performed using unpaired t-test.

Figure 38A:
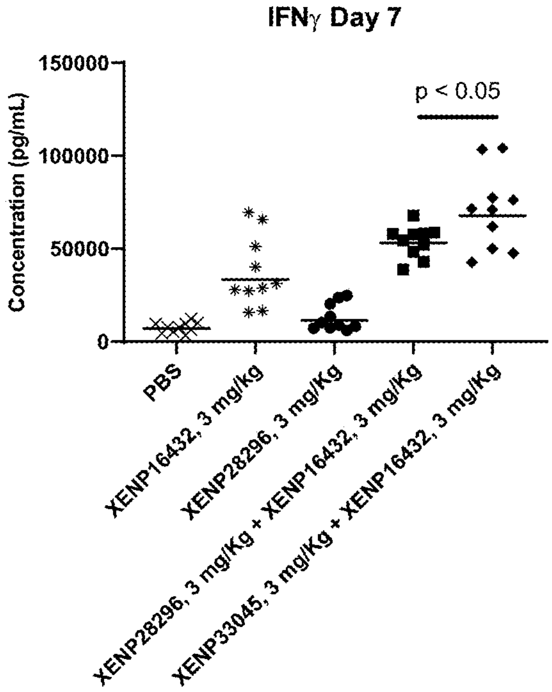
Figure 38B:
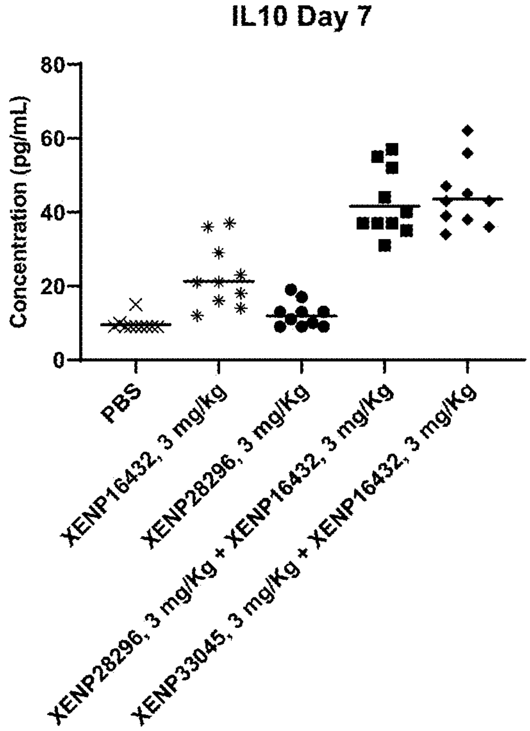
Figure 39A:
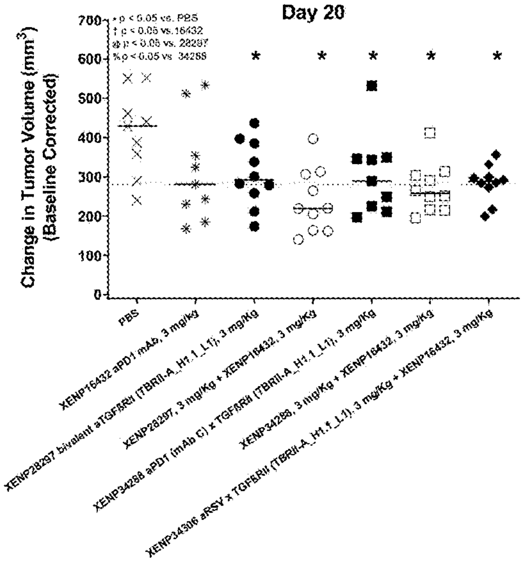
Figure 39B:
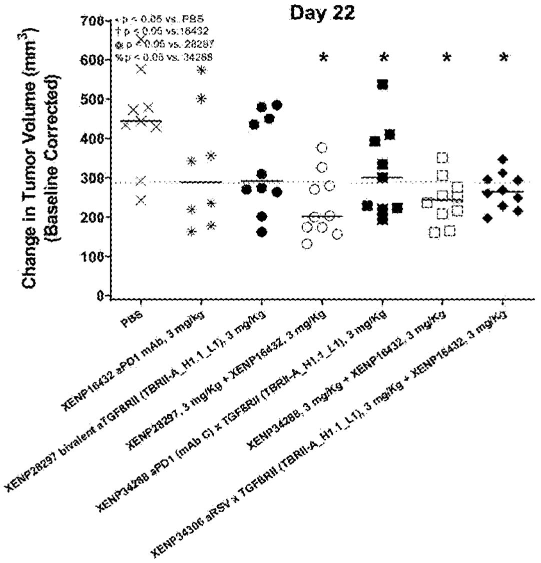
Figure 39C:
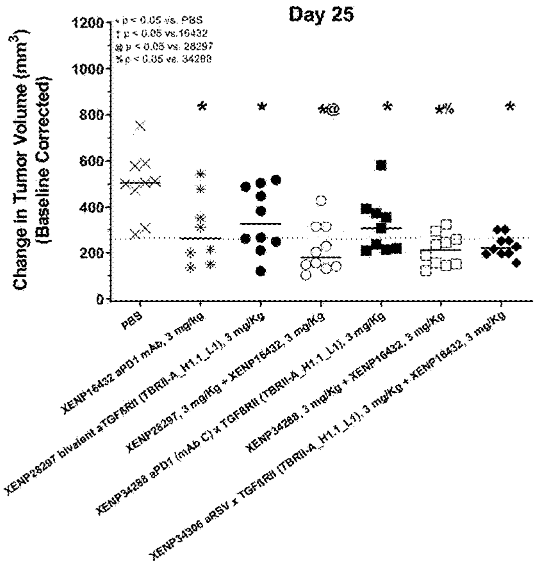
Figure 39D:
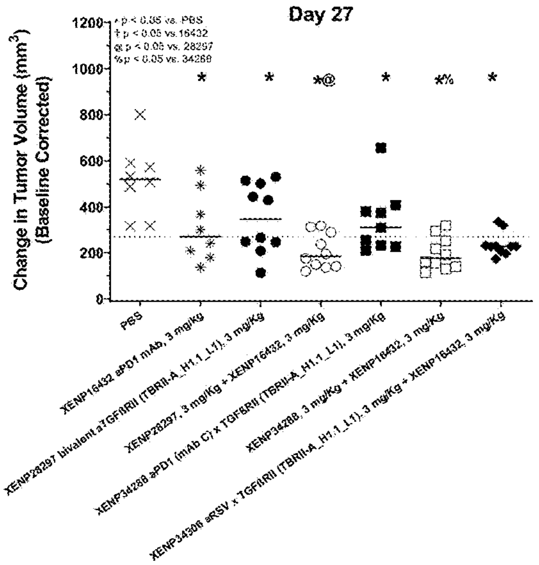
Figure 39E:
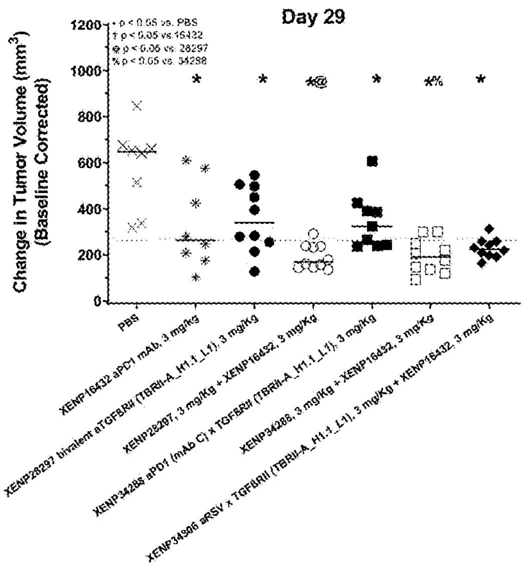
Figure 39F:
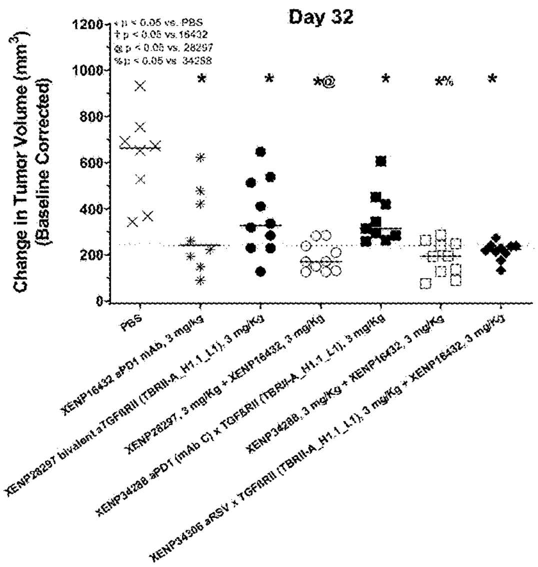
Figure 39G:
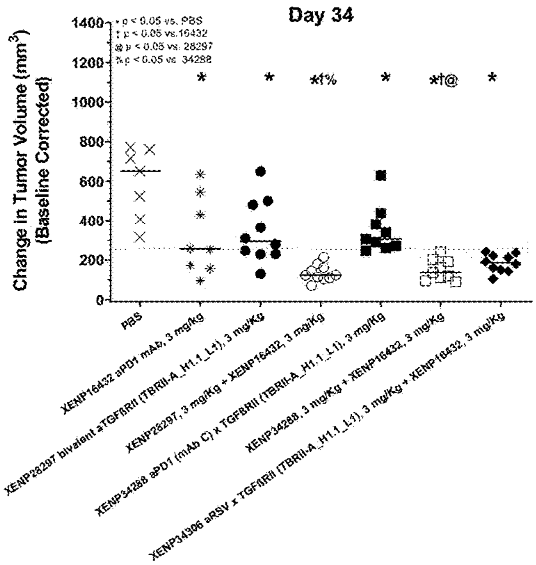
Figure 39H:
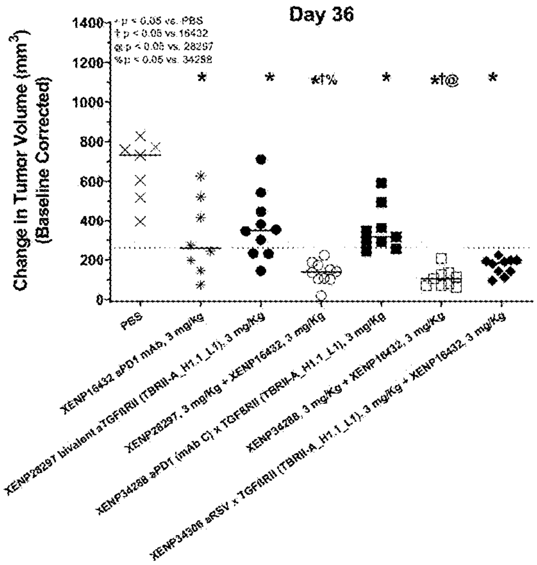

FIGS. 38A and 38B depict A) IFNγ concentration and B) IL10 concentration in serum of huPBMC-engrafted NSG mice on Day 7 after first dose with PBS control, XENP16432 anti-PD1 mAb (based on nivolumab with PVA_S267K), XENP28296 bivalent anti-TGFßRII mAb based on TBRII-A, XENP28296 in combination with XENP16432, and XENP33045 anti-TGFßRII×anti-PD1 bsAb based on TBRII-A in combination with XENP16432. The data show that the test articles enhanced secretion of IFNγ and IL-10; and notably, XENP33045 in combination with PD-1 blockade induced significantly enhanced secretion of IFNγ by Day 7 in comparison to XENP28296 in combination with PD-1 blockade (statistics on log-transformed data). Statistics were performed using unpaired t-test on log-transformed data.

FIGS. 39A-39H depict tumor volume (as determined by caliper measurements) on Days A) 20, B) 22, C) 25, D) 27, E) 29, F) 32, G) 34, and H) 36 in MDA-MB231 and huPBMC-engrafted NSG-DKO mice dosed with PBS, XENP16432 (a bivalent anti-PD1 mAb), XENP28297 (bivalent anti-TGFßRII mAb based on TBRII-A) alone or in combination with XENP16432, XENP34288 (anti-TGFßRII×anti-PD1 bsAb based on TBRII-A) alone or in combination with XENP16432, and XENP34306 (control anti-TGFßRII×anti-RSV bsAb based on TBRII-A) in combination with XENP16432. The data show that by Day 20, all of the TGFßRII blockade test article induced enhanced anti-tumor activity compared to no treatment. By Day 25, TGFßRII blockade in combination with PD-1 blockade enhanced anti-tumor activity in comparison to TGFßRII blockade alone. By Day 34, TGFßRII blockade in combination with PD-1 blockade additionally enhanced anti-tumor activity in comparison to PD1 blockade alone. Statistics was performed on baseline corrected data using Mann-Whitney test.

Figure 40:
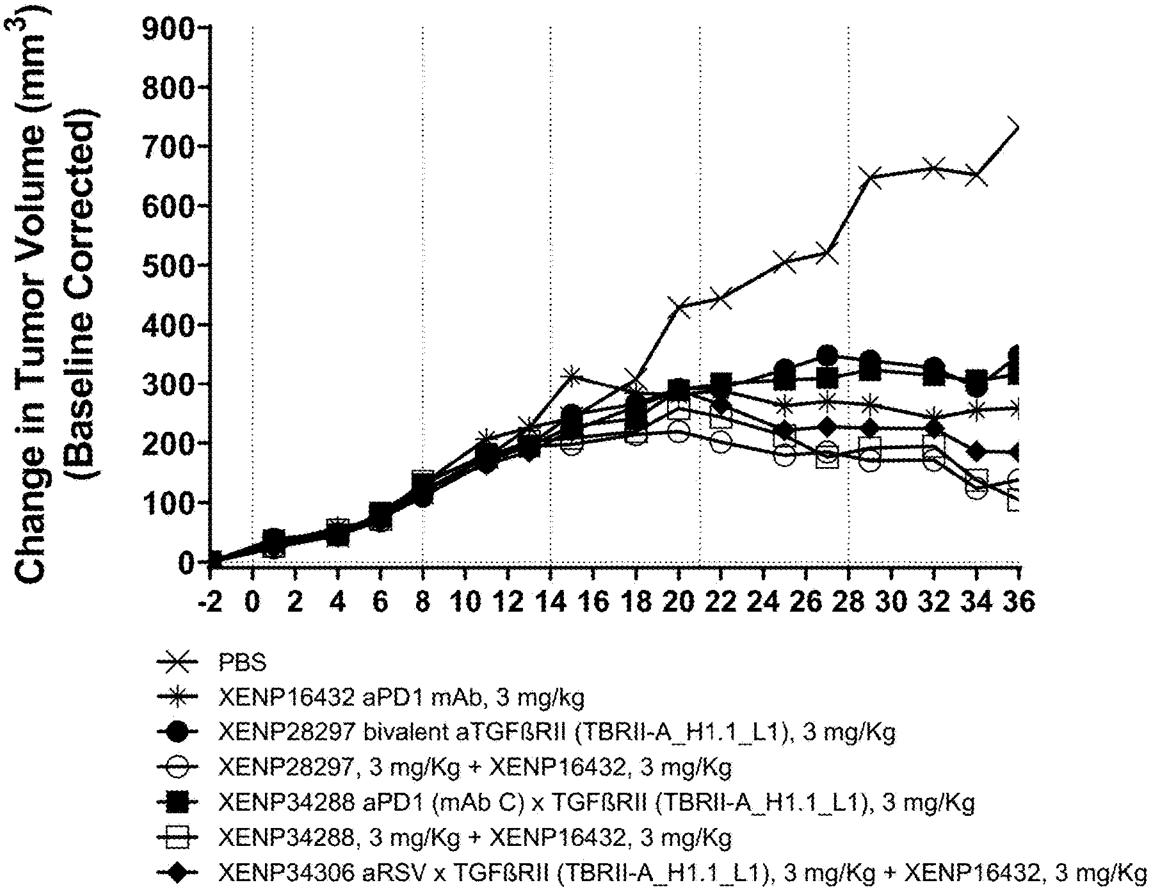
Figure 41A:
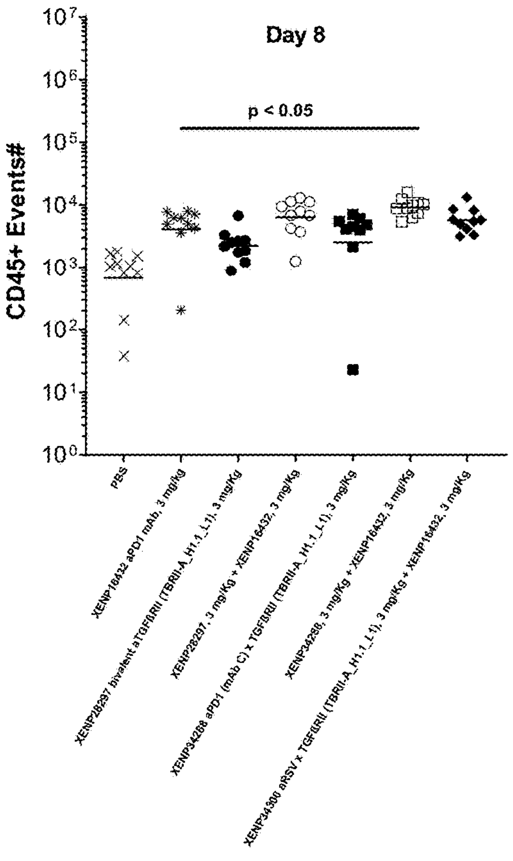
Figure 41B:
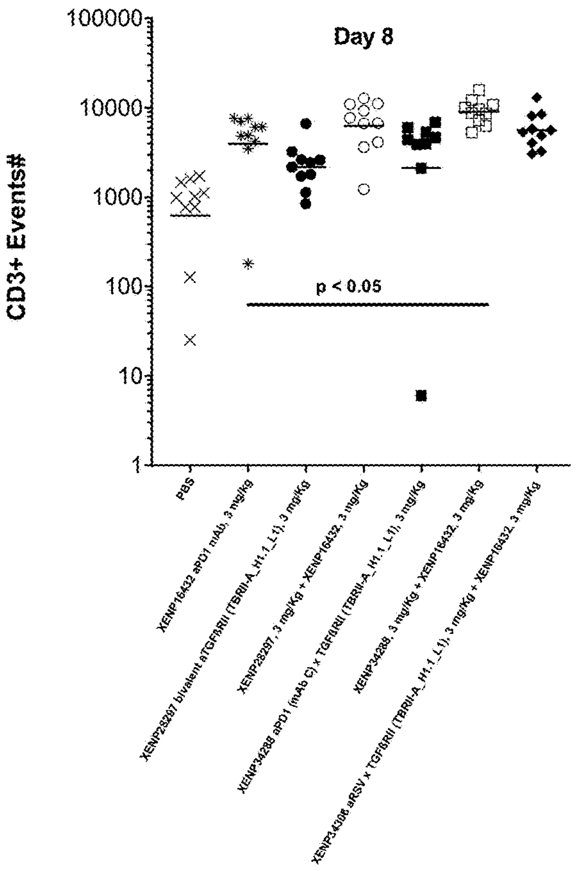
Figure 41C:
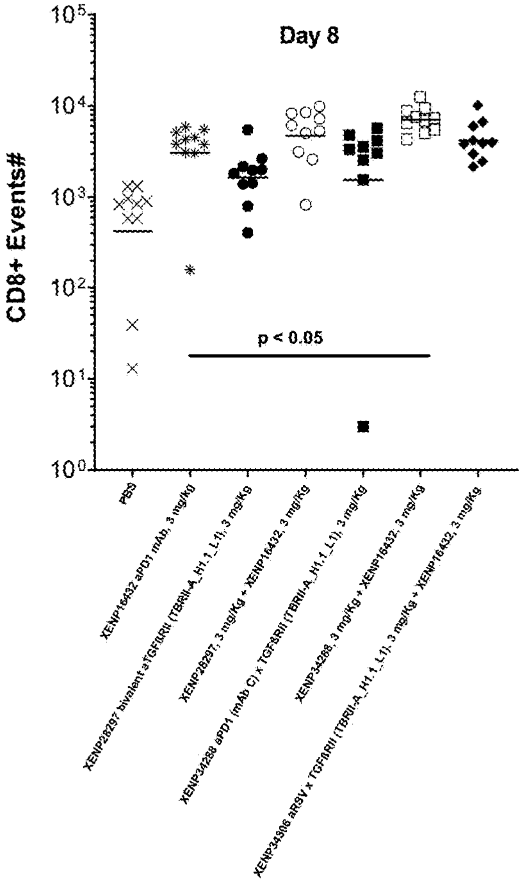
Figure 41D:
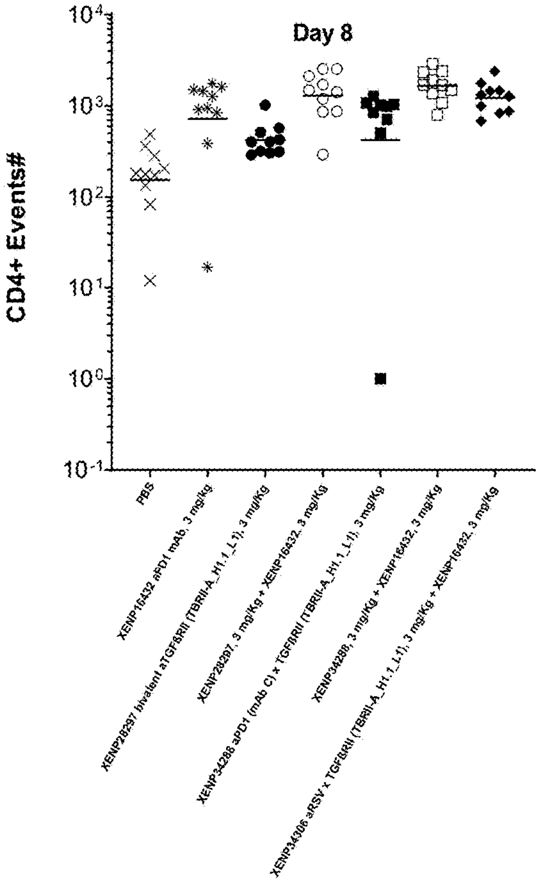

FIG. 40 depicts tumor volume (as determined by caliper measurements) over time in MDA-MB231 and huPBMC-engrafted NSG-DKO mice dosed with PBS, XENP16432 (a bivalent anti-PD1 mAb), XENP28297 (bivalent anti-TGFßRII mAb based on TBRII-A) alone or in combination with XENP16432, XENP34288 (anti-TGFßRII×anti-PD1 bsAb based on TBRII-A) alone or in combination with XENP16432, and XENP34306 (control anti-TGFßRII×anti-RSV bsAb based on TBRII-A) in combination with XENP16432.

FIGS. 41A-41D depict A) human CD45+, B) human $CD3^+$, C) human $CD8^+$, and D) human $CD4^+$ expansion in MDA-MB231 and huPBMC-engrafted NSG-DKO mice dosed with PBS, XENP16432 (a bivalent anti-PD1 mAb), XENP28297 (bivalent anti-TGFßRII mAb based on TBRII-A) alone or in combination with XENP16432, XENP34288 (anti-TGFßRII×anti-PD1 bsAb based on TBRII-A) alone or in combination with XENP16432, and XENP34306 (control anti-TGFßRII×anti-RSV bsAb based on TBRII-A) in combination with XENP16432. The data show that combination of anti-TGFßRII×anti-PD1 bispecific antibody with PD-1 blockade enabled significantly enhanced early expansion of lymphocytes (CD45+, $CD3^+$, and $CD8^+$) in comparison to treatment with PD-1 blockade alone.

FIGS. 42A-42E depict the thermal stability of TBRII-A variants formatted as His-tagged scFvs or His-tagged Fab domains, as determined by differential scanning fluorimetry. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIG. 43 depicts the thermal stability of select TBRII-A variants formatted as αTGFßRII×αPD1 or αTGFßRII×αRSV bispecific antibodies, as determined by differential scanning fluorimetry. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIGS. 44A-44E depict dissociation constant ($K_D$), association rate ($k_a$), and dissociation rate (kD) of TBRII-A variants formatted as His-tagged Fabs binding to human TGFßRII as determined by Octet, as well as fold-difference $K_D$ relative to wild-type H1L1. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIG. 45 depicts dissociation constant ($K_D$), association rate ($k_a$), and dissociation rate (kD) of select TBRII-A variants formatted as αTGFßRII×αPD1 bsAbs binding to human TGFßRII as determined by Octet, as well as fold-difference $K_D$ relative to wild-type H1L1. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position. * indicates that the data was gathered from a separate experiment.

FIG. 46 depicts dissociation constant ($K_D$), association rate ($k_a$), and dissociation rate (kD) of select TBRII-A variants formatted as αTGFßRII×αPD1 bsAbs binding to cynomolgus TGFßRII as determined by Octet, as well as fold-difference $K_D$ relative to wild-type H1L1. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIG. 47 depicts dissociation constant ($K_D$), association rate ($k_a$), and dissociation rate (kD) of select TBRII-A variants formatted as αTGFßRII×αRSV bsAbs binding to human TGFßRII as determined by Octet, as well as fold-difference $K_D$ relative to wild-type H1L1. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIG. 48 depicts dissociation constant ($K_D$), association rate ($k_a$), and dissociation rate (kD) of select TBRII-A variants formatted as αTGFßRII×αRSV bsAbs binding to cynomolgus TGFßRII as determined by Octet, as well as fold-difference $K_D$ relative to wild-type H1L1. Substitutions in variable heavy (VH) or variable light (VL) regions are based on Xencor numbering with Kabat numbering in parentheses. It should be noted that for the Kabat number in parentheses, some positions are numbered using letters as well; for example, in Kabat numbering, there is one amino acid in the VH at position 35a (W35a) but a different amino acid at position 35b (G35b); that is, the inclusion of the small letters denotes a position, not a particular amino acid in that position.

FIGS. 49A and 49B depict the suppression of TGFß1-induced SMAD2/3 phosphorylation in A) $CD8^+$ T cells and B) $CD4^+$ T cells by anti-TGFßRII×anti-PD1 bispecific antibody variants having modulated TGFßRII binding affinities. The data show that potency of the bispecific antibodies correlates with their TGFßRII binding affinity with tighter affinity correlating with stronger blockade.

Figure 50A:
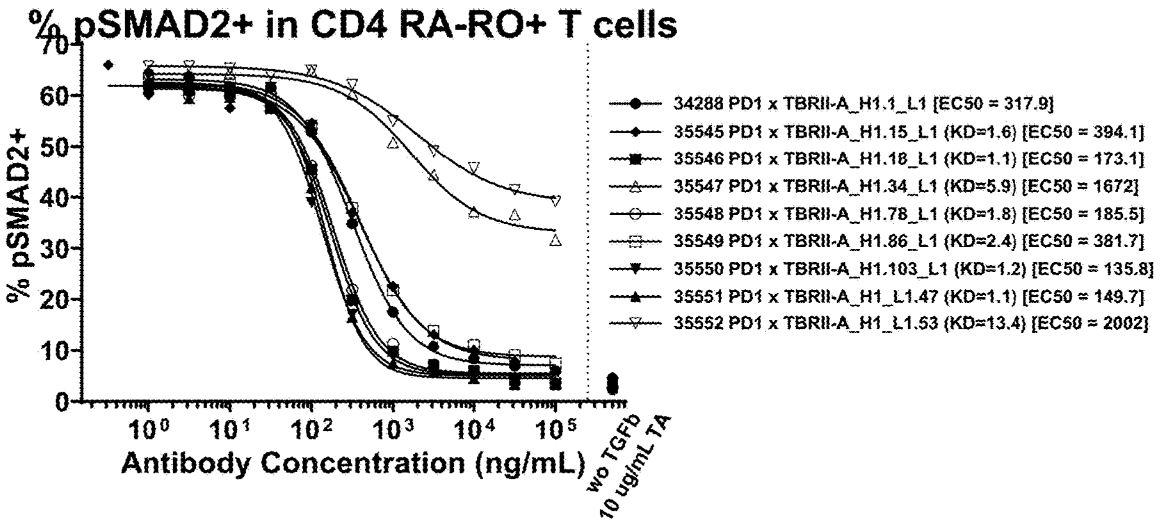
Figure 50B:
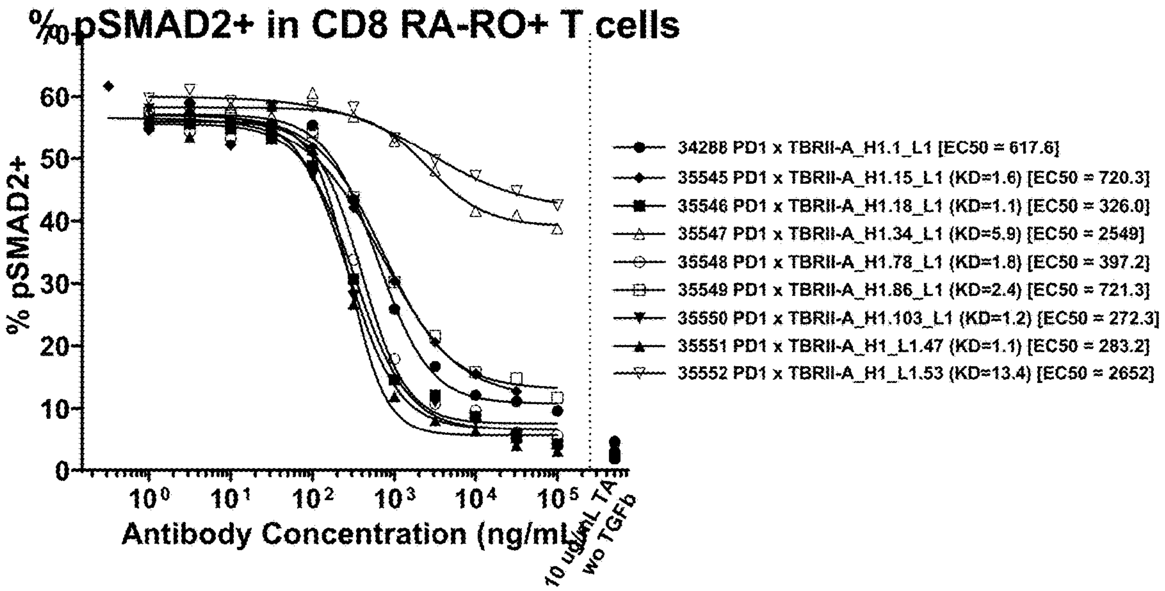

FIGS. 50A and 50B depict suppression of TGFßR1-induced SMAD2 phosphorylation in A) CD4+CD45RA−CD45RO+ and B) CD8+CD45RA−CD45RO+ T cells by αTGFßR2×αPD1 mAbs having mAb C_H1_L1.1 PD-1 binding domain and TGFßRII binding domains having TGFßRII binding affinities ranging from 1.1 nM to 13.4 nM. The data show that suppression potency correlates to TGFßRII binding affinity (i.e. weaker binding→reduced suppression potency).

FIG. 51 shows KD (M), $k_{on}$ (1/Ms), and $k_{dis}$ (1/s) of a series of stability enhanced TBRII-A variants in the context of αTGFßRII×αPD1 bsAbs. The data show that stability engineering resulted in a range of affinities.

FIG. 52 shows KD (M), $k_{on}$ (1/Ms), and $k_{dis}$ (1/s) of a series of stability enhanced TBRII-A variants in the context of αTGFßRII×αPD1 bsAbs. The data show that stability engineering resulted in a range of affinities.

FIG. 53 shows KD (M), $k_{on}$ (1/Ms), and $k_{dis}$ (1/s) of a series of stability enhanced TBRII-A variants in the context of αTGFßRII×αPD1, αTGFßRII×αCD5, or αTGFßRII×αRSV bsAbs. The data show that stability engineering resulted in a range of affinities.

Figure 54A:
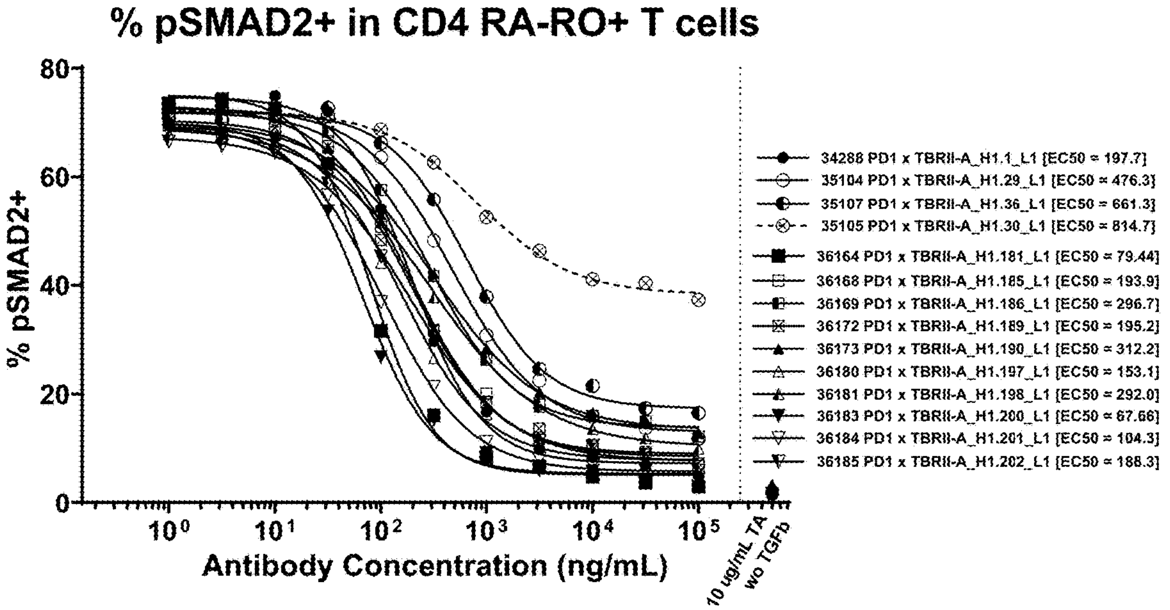
Figure 54B:
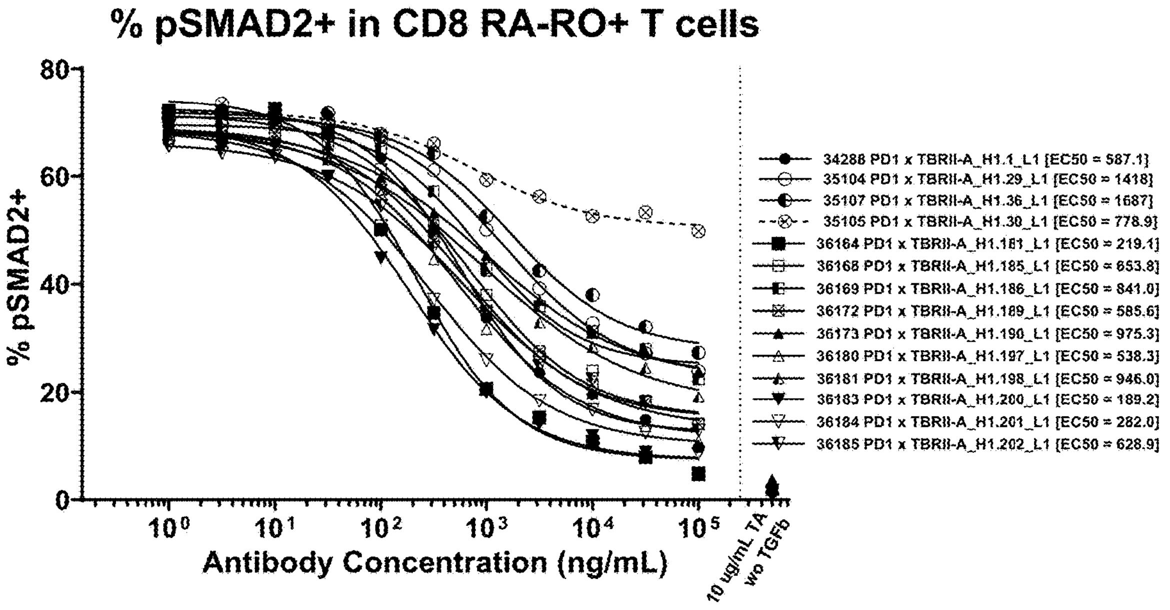

FIGS. 54A and 54B depict suppression of TGFßR1-induced SMAD2 phosphorylation in A) CD4+CD45RA−CD45RO+ and B) CD8+CD45RA−CD45RO+ T cells by αTGFßR2×αPD1 mAbs having mAb C_H1_L1.1 PD-1 binding domain and stability-optimized TGFßRII binding domains having a range of TGFßRII binding affinities. The data show that suppression potency correlates to TGFßRII binding affinity.

Figure 55:
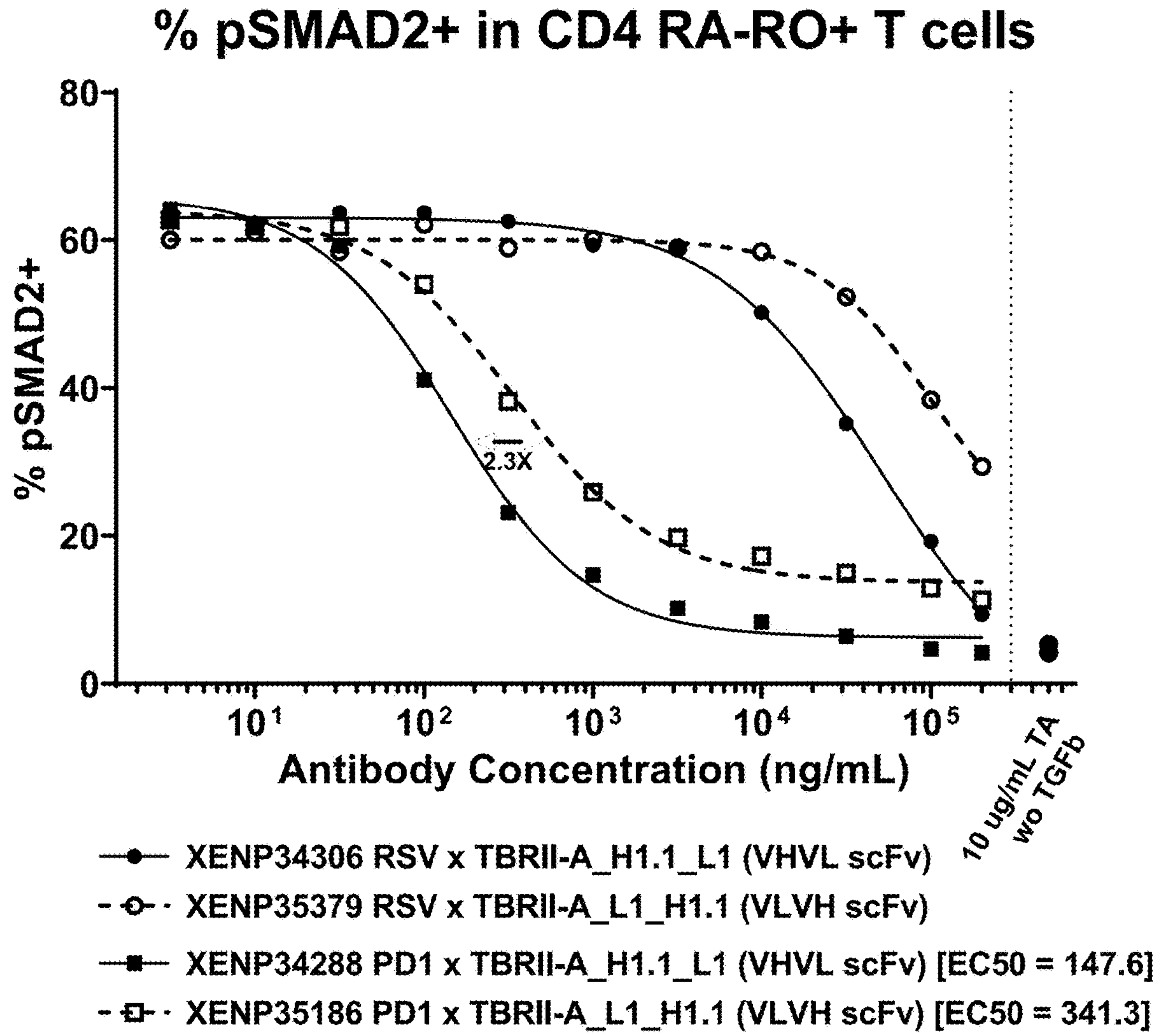

FIG. 55 depicts suppression of TGFßR1-induced SMAD2 phosphorylation in CD4+CD45RA−CD45RO+ T cells by αTGFßR2×αPD1 mAbs having mAb C_H1_L1.1 PD-1 binding domain and αTGFßRII scFv in the VHVL orientation or the VLVH orientation. The data show that the VLVH orientation reduces suppression potency by >2 fold.

Figure 56:
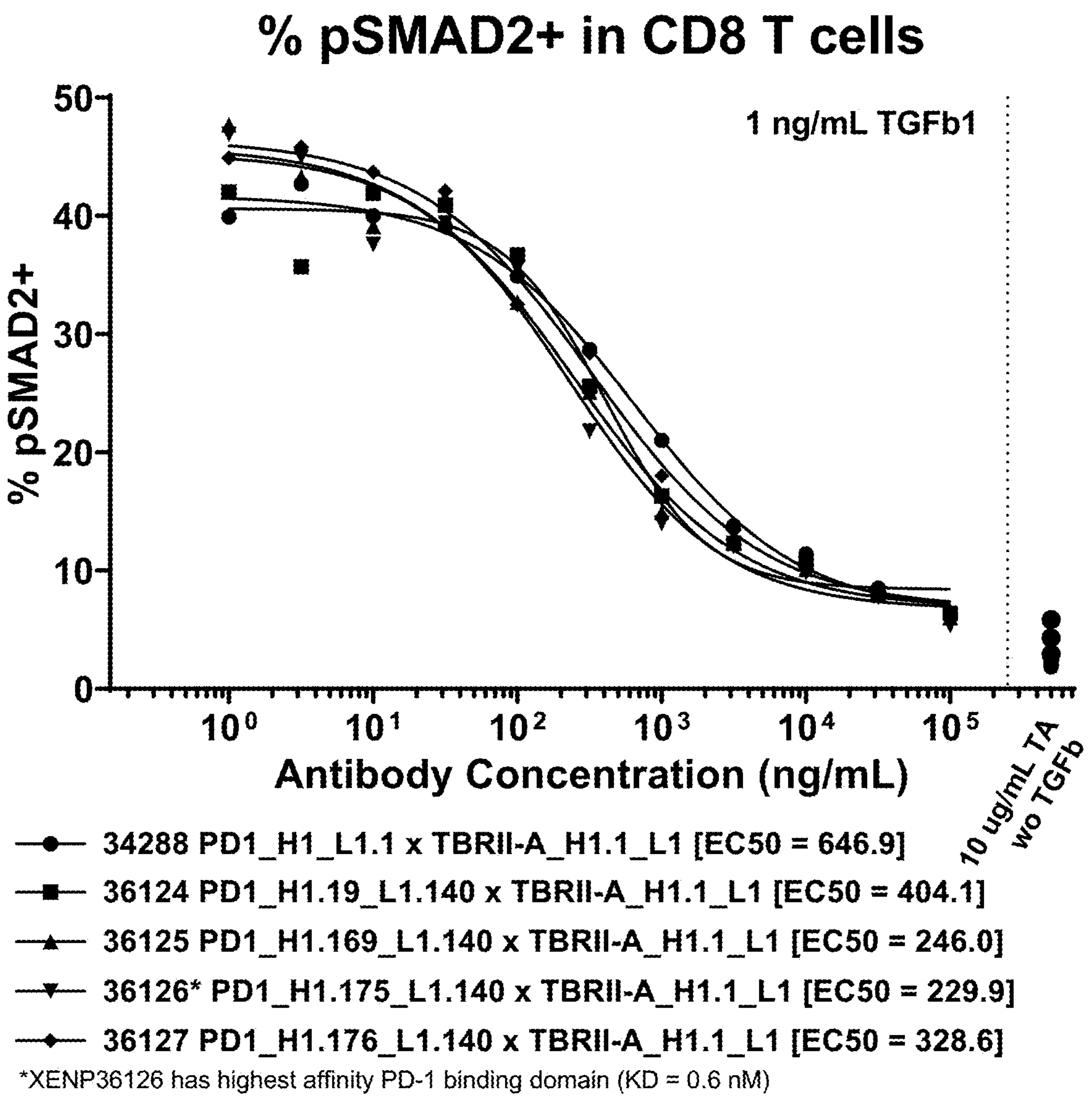

FIG. 56 depicts suppression of TGFßR1-induced SMAD2 phosphorylation in CD4+CD45RA−CD45RO+ T cells by αTGFßR2×αPD1 mAbs having TGRII-A_H1.1_L1 TGFßRII binding domain and mAb C-derived PD-1 binding domain of varying affinities. The data show that the highest affinity PD1 binding domain (mAb C_H1.175_L1.140) enables 3-fold enhanced suppression potency.

Figure 57A:
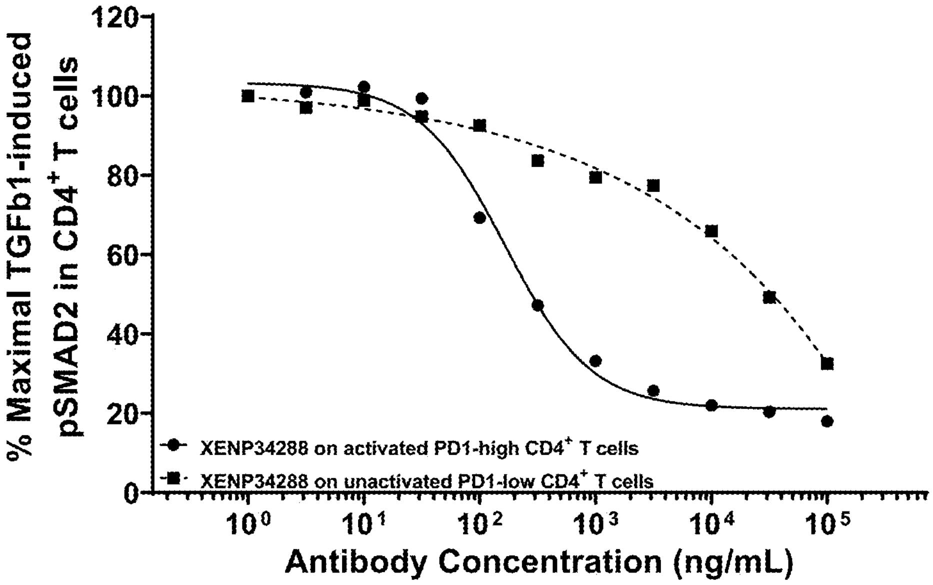
Figure 57B:
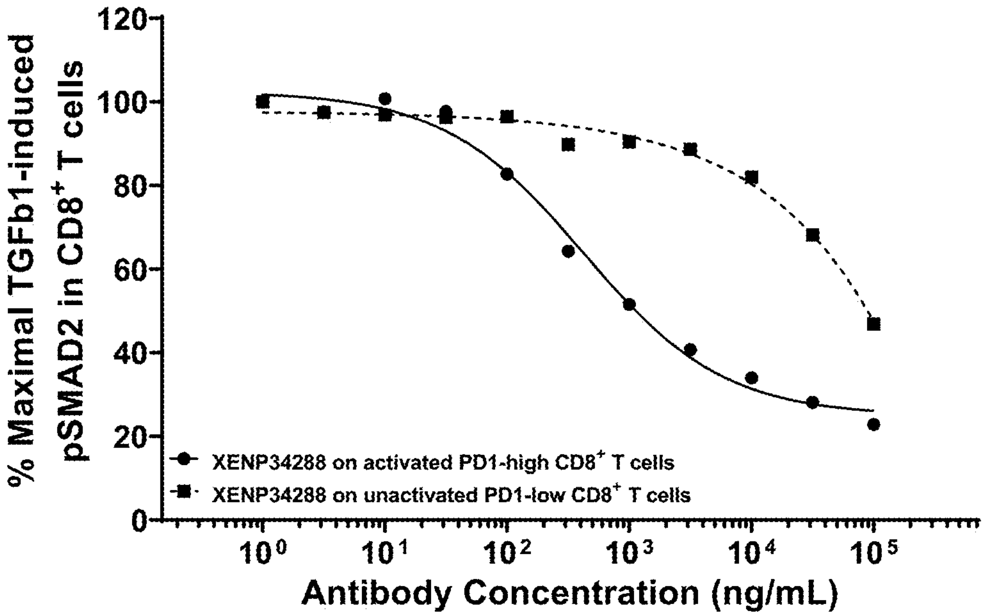

FIGS. 57A and 57B depict the suppression of TGFß1-induced SMAD2/3 phosphorylation by XENP34288 on unactivated and activated A) $CD4^{+}$ T cells and B) $CD8^{+}$ T cells. The data show that blocking activity is highly selective for activated (PD1-high) T cells over unactivated (PD1-low) T cells.

Figure 58A:
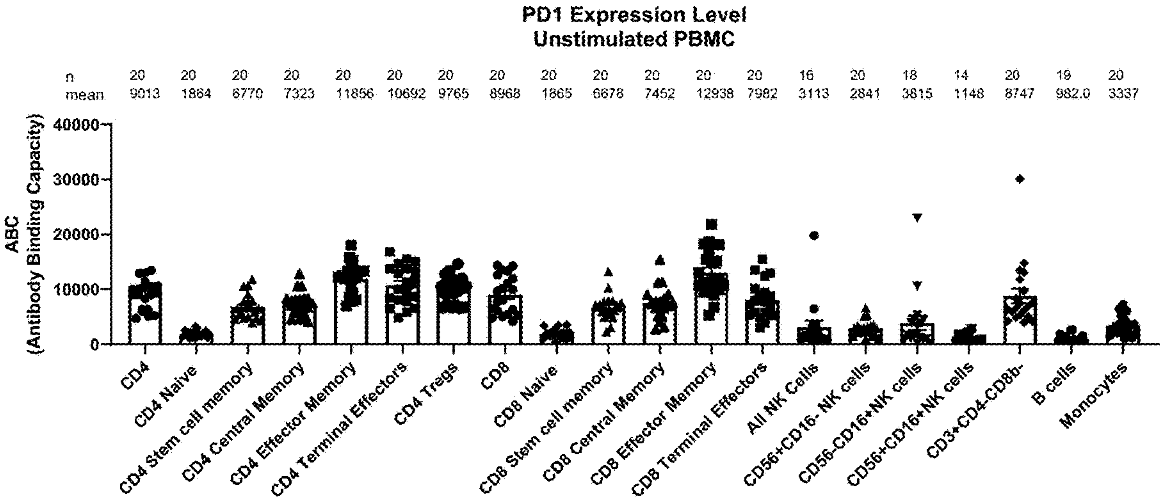
Figure 58B:
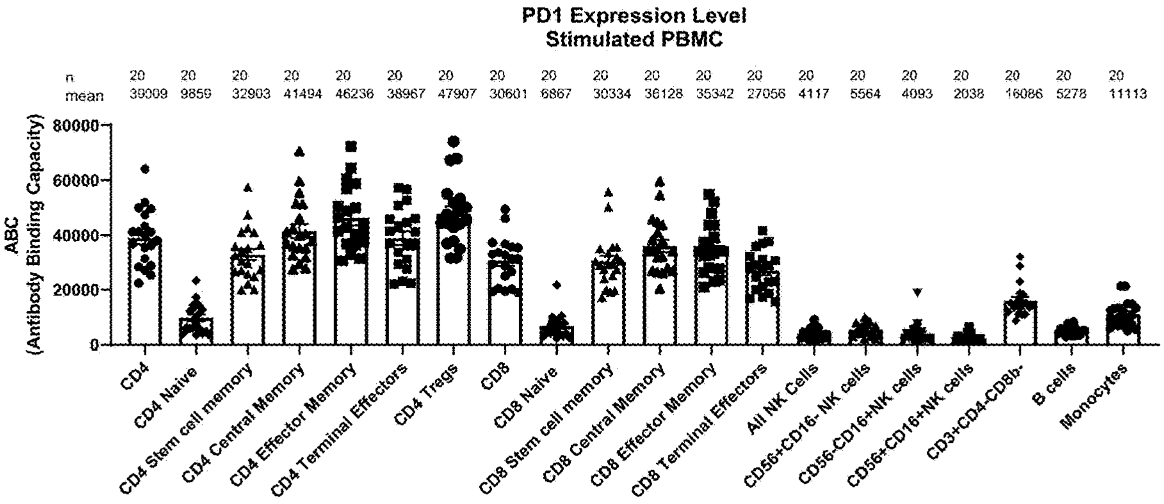

FIGS. 58A and 58B depict the expression of PD1 on subsets of lymphocyte population in a) unstimulated PBMC and b) stimulated PBMC.

Figure 59A:
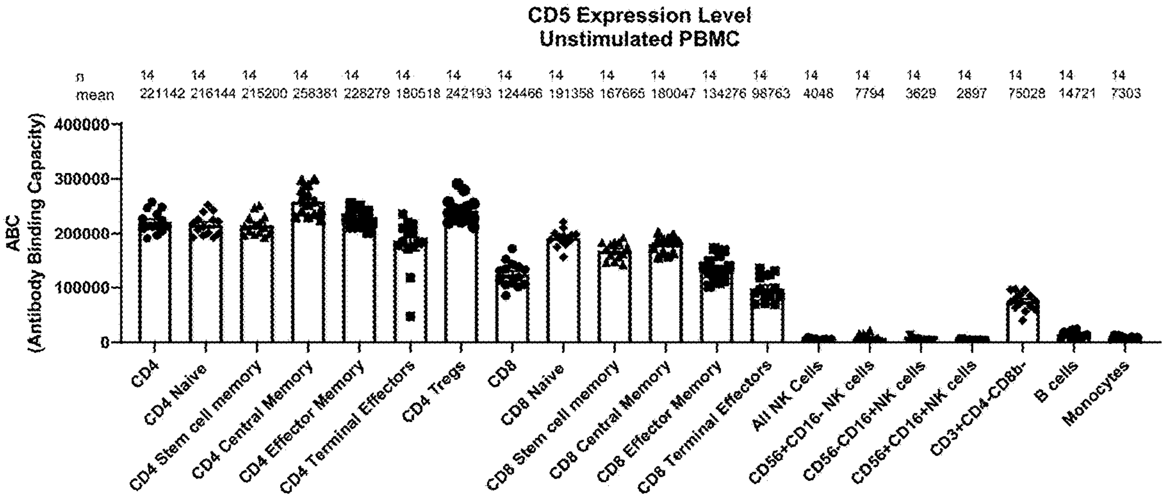
Figure 59B:
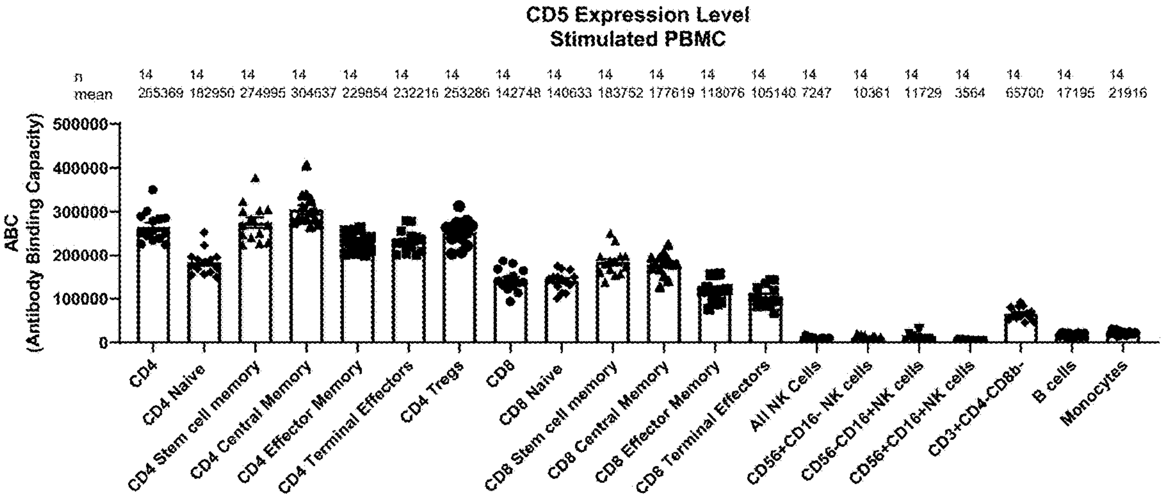

FIGS. 59A and 59B depict the expression of CD5 on subsets of lymphocyte population in a) unstimulated PBMC and b) stimulated PBMC.

FIG. 60 depicts the sequences for CD5 for both human and cynomolgus monkey to facilitate the development of antigen binding domains that bind to both for ease of clinical development.

FIG. 61 depicts the variable heavy and variable light chain sequences for clone 5D7, an exemplary CD5 binding domain, as well as the sequences for XENP35401, an anti-CD5 mAb based on 5D7 and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 62 depicts the variable heavy and variable light chain sequences for clone Cd5-A, an exemplary CD5 binding domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIGS. 63A and 63B depict the variable heavy and variable light chain sequences for clone Cd5-B, an exemplary CD5 binding domain. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format. It should be noted that each of the Cd5-B VH variants depicted herein can be paired with any of the Cd5-B VL variants depicted herein; and each of the Cd5-B VL variants depicted herein can be paired with any of the Cd5-B VH variants depicted herein.

FIGS. 64A-64W depict sequences for illustrative anti-TGFßRII×anti-CD5 bsAbs in the "1+1 Fab-scFv-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the VH and VL domains using other numbering systems. As will be appreciated by those in the art, the VH and VL domains can be formatted as Fab or scFvs for use in the anti-TGFßRII×anti-CD5 bsAbs of the invention.

FIG. 65 depicts sequences for illustrative anti-TGFßRII×anti-CD5 bsAbs in the "1+1 Fab-VHH-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the VH and VL domains using other numbering systems. As will be appreciated by those in the art, the VH and VL (where applicable) domains can be formatted as Fab or scFvs for use in the anti-TGFßRII×anti-CD5 bsAbs of the invention.

FIG. 66 depicts sequences for illustrative anti-TGFßRII×anti-CD5 bsAbs in the "1+1 VHH-scFv-Fc" format. The CDRs are underlined, linkers are double underlined (although as will be appreciated by those in the art, the linkers can be replaced by other linkers), and slashes (/) indicate the border(s) between the variable regions and constant/Fc regions. As noted herein and is true for every sequence herein containing CDRs, the exact identification of the CDR locations may be slightly different depending on numbering used as is shown in Table 2, and thus included herein are not only the CDRs that are underlined but also CDRs included within the VH and VL domains using other numbering systems. As will be appreciated by those in the art, the VH and VL (where applicable) domains can be formatted as Fab or scFvs for use in the anti-TGFßRII×anti-CD5 bsAbs of the invention.

Figure 67A:
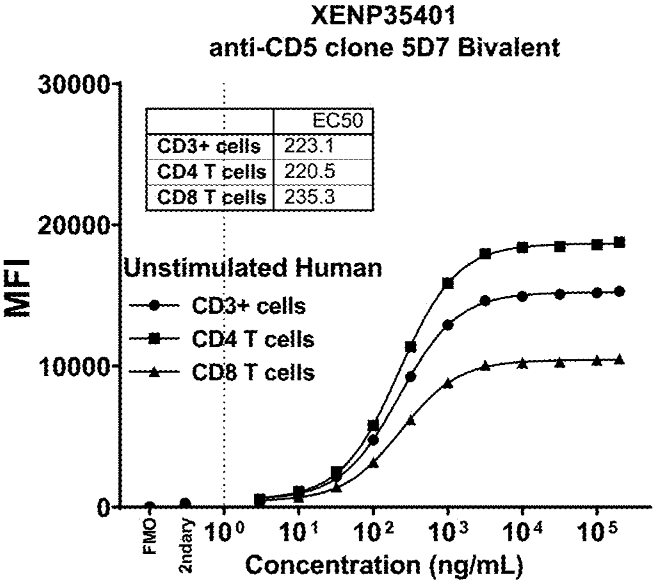
Figure 67B:
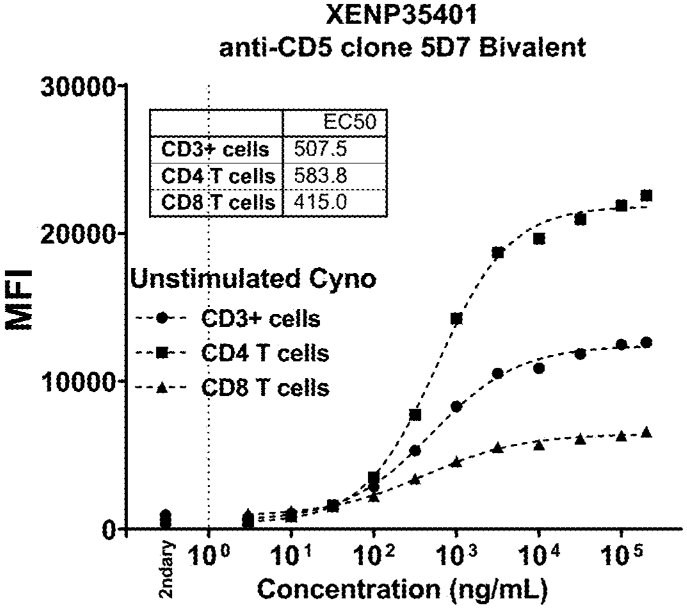

FIGS. 67A and 67B depict the binding of XENP35401 bivalent anti-CD5 mAb based on clone 5D7 on A) human T cells and B) cynomolgus T cells.

FIG. 68 depicts dissociation constant ($K_D$) of anti-TGFßRII×anti-CD5 having different CD5-targeting arms for human and cynomolgus CD5 as determined by Octet. N.R. indicates no response; and L.R. indicates low response.

Figure 69A:
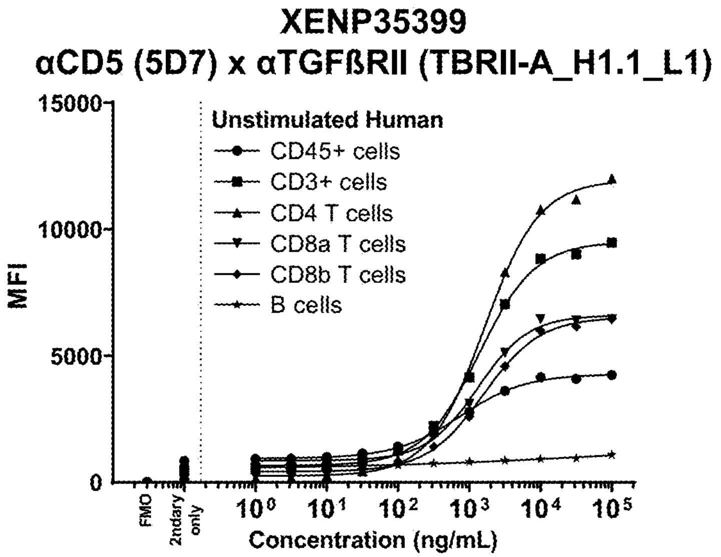
Figure 69B:
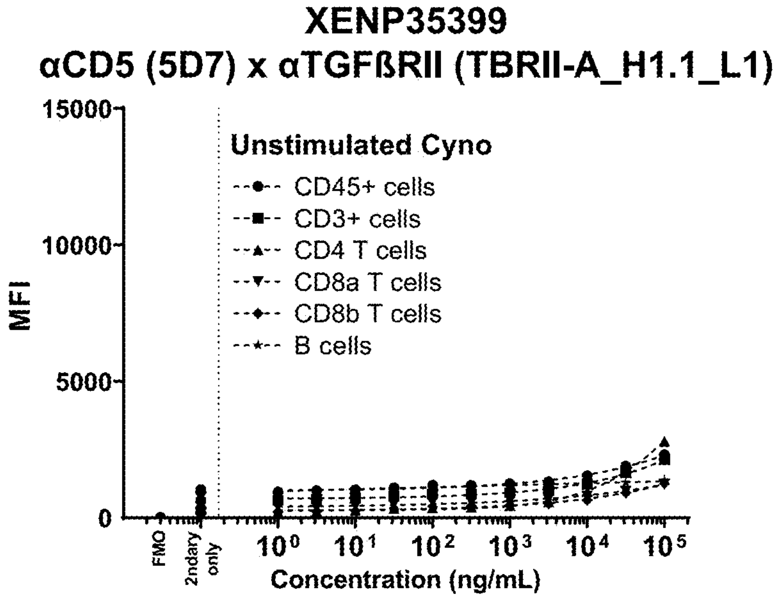

FIGS. 69A and 69B depict the binding of XENP35399 anti-TGFßRII×anti-CD5 having CD5-targeting arm based on clone 5D7 on A) human T cells and B) cynomolgus T cells.

Figure 70A:
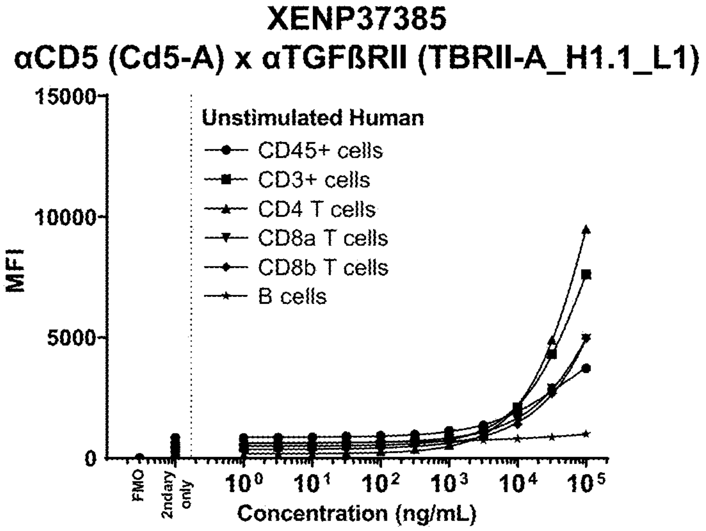
Figure 70B:
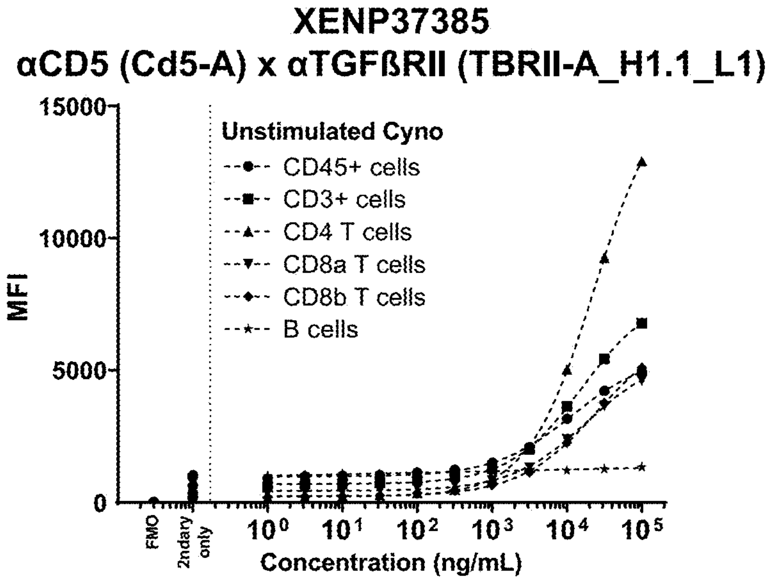

FIGS. 70A and 70B depict the binding of anti-TGFßRII× anti-CD5 having CD5-targeting arm based on clone Cd5-A on A) human T cells and B) cynomolgus T cells.

Figure 71A:
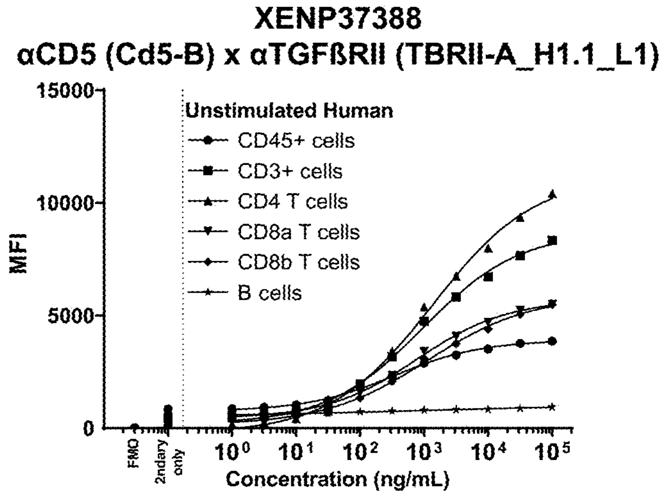
Figure 71B:
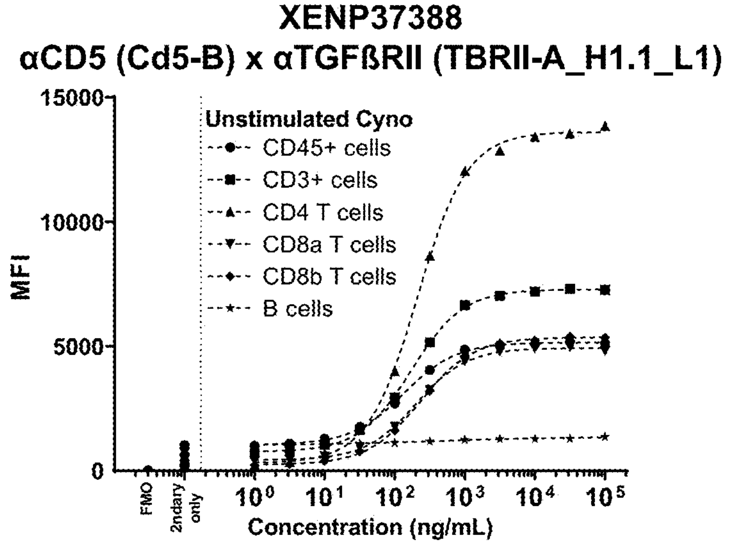

FIGS. 71A and 71B depict the binding of anti-TGFßRII× anti-CD5 having CD5-targeting arm based on clone Cd5-B on A) human T cells and B) cynomolgus T cells.

FIGS. 72A and 72B depict the suppression of TGFß1-induced SMAD2/3 phosphorylation by XENP35399 (αTGFßRII×αCD5) on A) unactivated and B) activated $CD4^+$ T cells in comparison to XENP34288 (αTGFßRII× αPD1) and XENP34306 (αTGFßII×αRSV control).

Figure 73A:
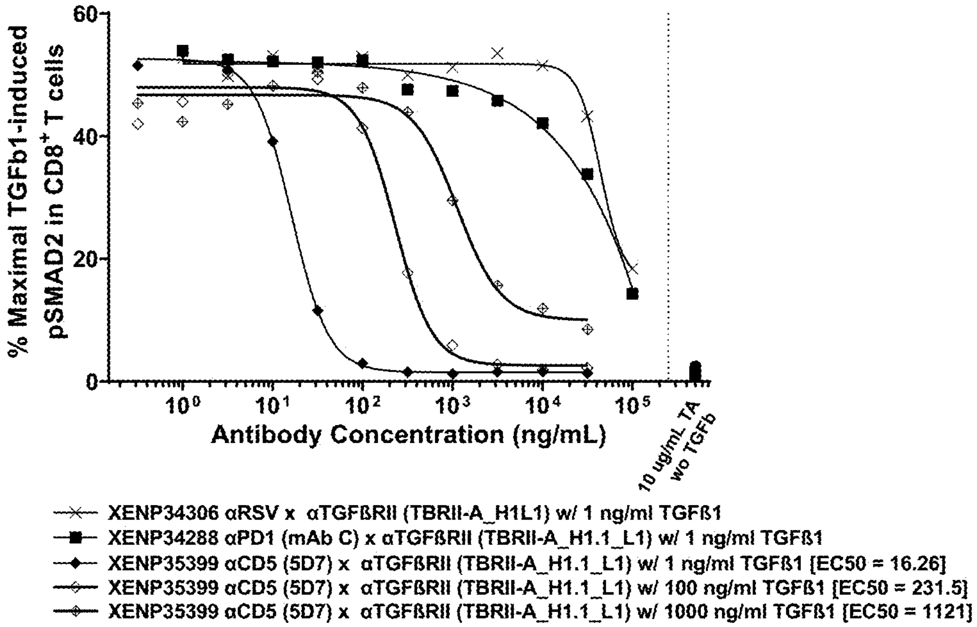
Figure 73B:
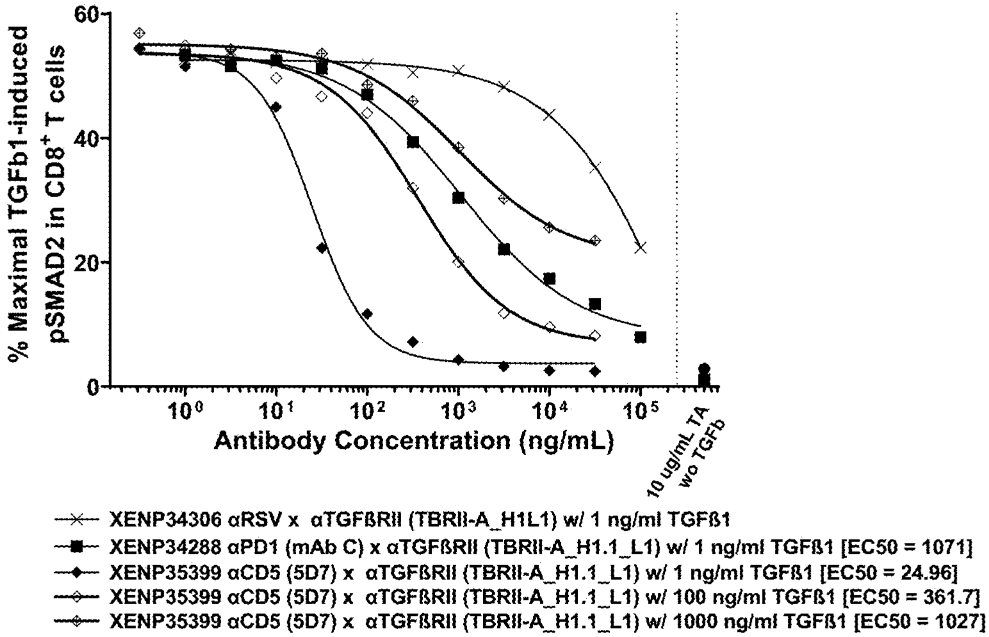

FIGS. 73A and 73B depict the suppression of TGFß1-induced SMAD2/3 phosphorylation by XENP35399 (αTGFßRII×αCD5) on A) unactivated and B) activated $CD8^+$ T cells in comparison to XENP34288 (αTGFßRII× αPD1) and XENP34306 (αTGFßII×αRSV control).

Figure 74A:
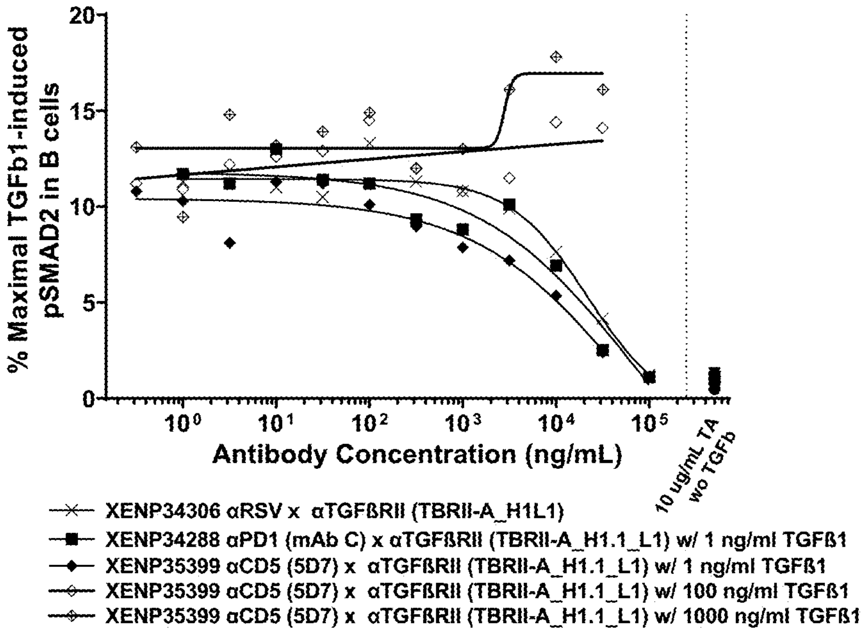
Figure 74B:
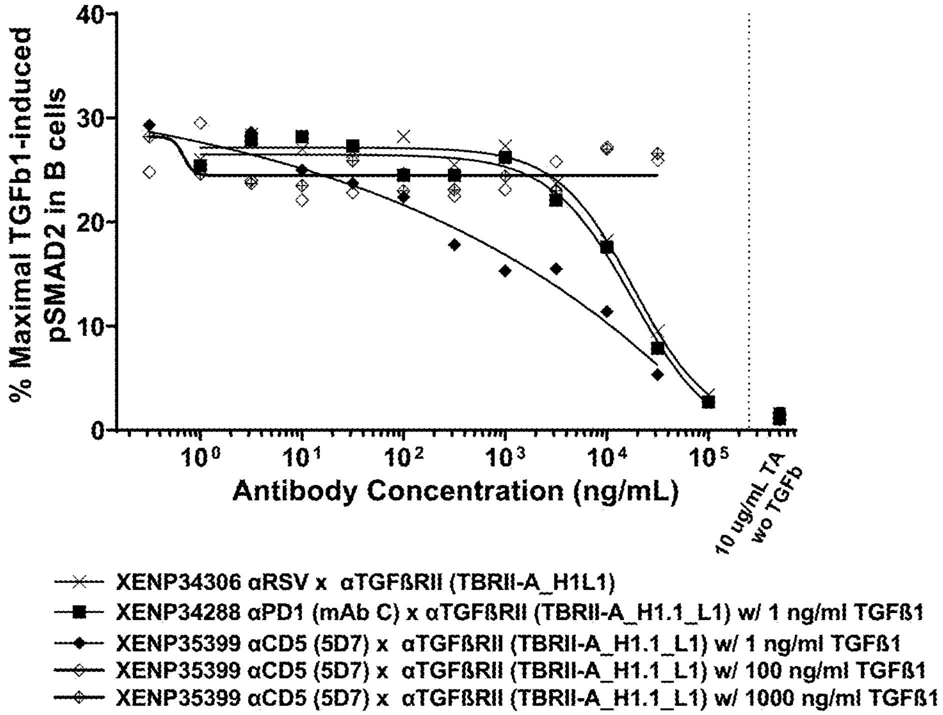
Figure 75A:
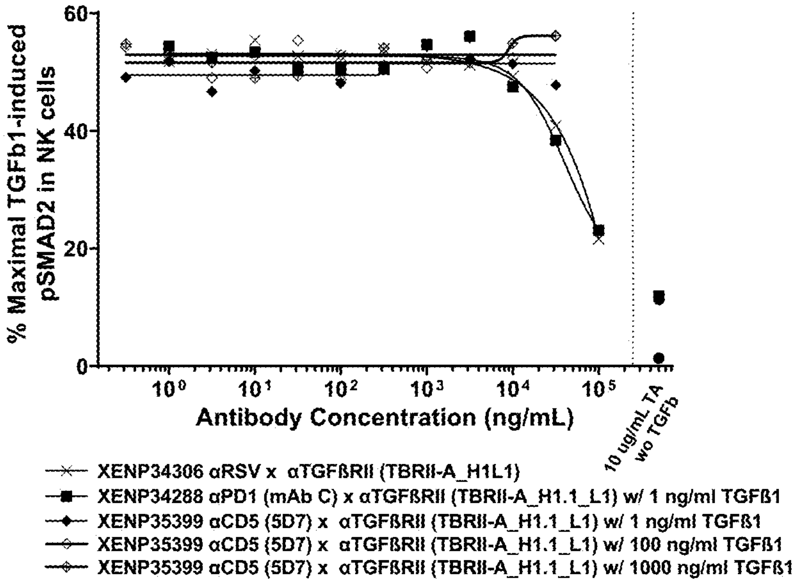
Figure 75B:
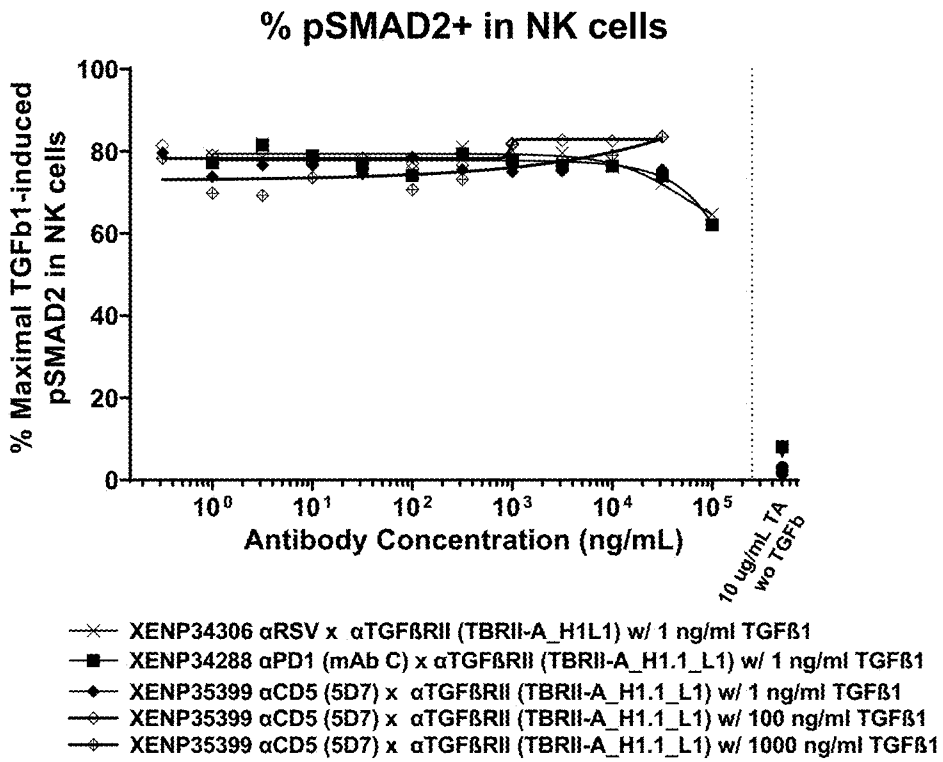

FIGS. 74A and 74B depict the suppression of TGFß1-induced SMAD2/3 phosphorylation by XENP35399 (αTGFßRII×αCD5) on A) unactivated and B) activated B cells in comparison to XENP34288 (αTGFßRII×αPD1) and XENP34306 (αTGFßII×αRSV control). Both the anti-TGFßRII×anti-PD-1 bsAb and the anti-TGFßRII×anti-CD5 bsAb demonstrated little to no blocking activity on B cells (CD5 and PD1 low/negative) except at very high concentrations FIGS. 75A and 75B depict the suppression of TGFß1-induced SMAD2/3 phosphorylation by XENP35399 (αTGFßRII×αCD5) on A) unactivated and B) activated NK cells in comparison to XENP34288 (αTGFßRII×αPD1) and XENP34306 (αTGFßII×αRSV control). Both the anti-TGFßRII×anti-PD-1 bsAb and the anti-TGFßRII×anti-CD5 bsAb demonstrated little to no blocking activity on NK cells (CD5 and PD1 low/negative) except at very high concentrations.

FIGS. 76A and 76B depict the suppression of TGFß1-induced SMAD2/3 phosphorylation by αTGFßRII×αCD5 having reduced affinity TGFßRII binding and alternative CD5-targeting arms on A) $CD4^+$ T cells and B) $CD8^+$ T cells. bsAbs based on anti-CD5 clone Cd5-A and Cd5-B also demonstrate blocking activity. XENP37385 which has a lower affinity CD5-targeting arm than XENP35399 and XENP37388 demonstrated weaker potency in blocking activity. XENP36132 and XENP37401 which both have reduced TGFßRII binding also demonstrated weaker potency in blocking activity.

Figure 77A:
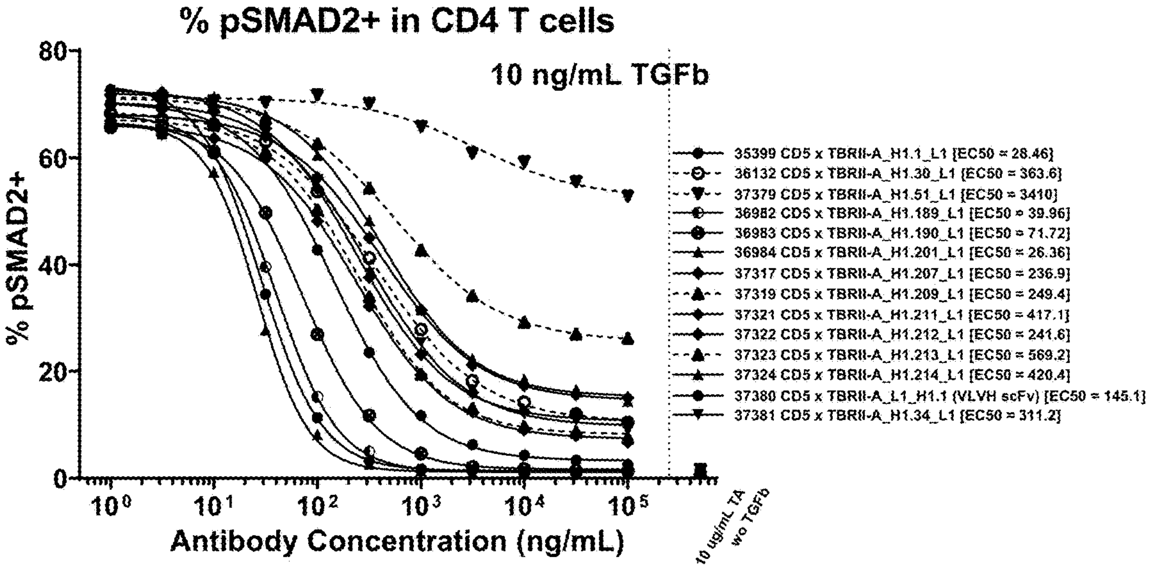
Figure 77B:
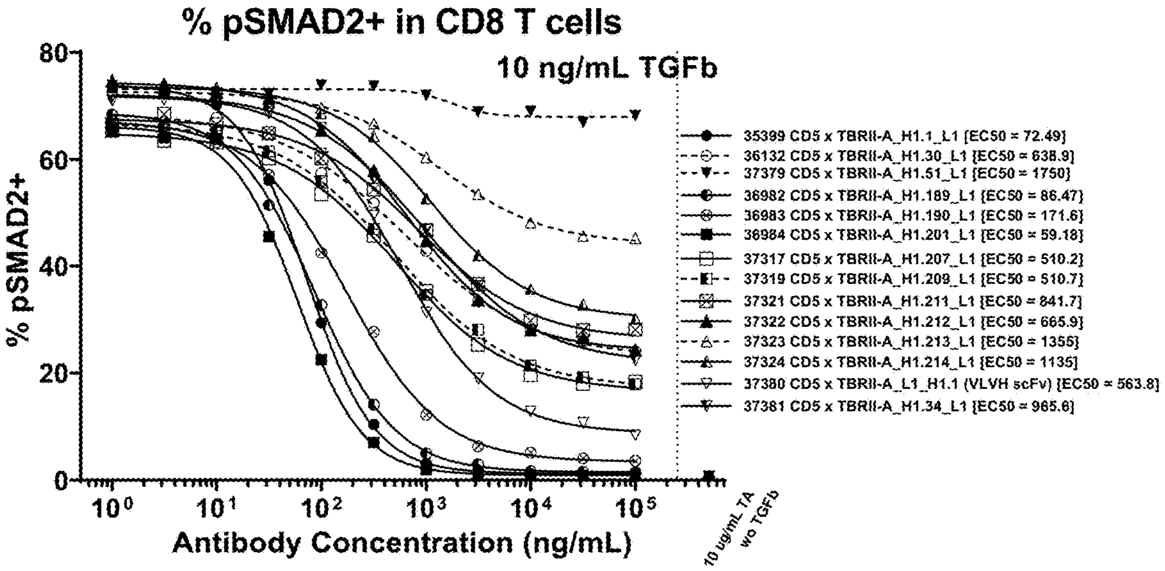

FIGS. 77A and 77B depict suppression of TGFßR1-induced SMAD2 phosphorylation in A) CD4 T cells and B) CD8 T cells by αTGFßR2×αCD5 mAbs having 5D7 CD5 binding domain and stability-optimized TGFßRII binding domains having a range of TGFßRII binding affinities. The data show that suppression potency correlates to TGFßRII binding affinity enabling high potency suppressors such as XENP36984 having TBRII-A_H1.201_L1 binding domain and mid-potency suppressors such as XENP37322 having TBRII-A_H1.212_L1.

Figure 78:
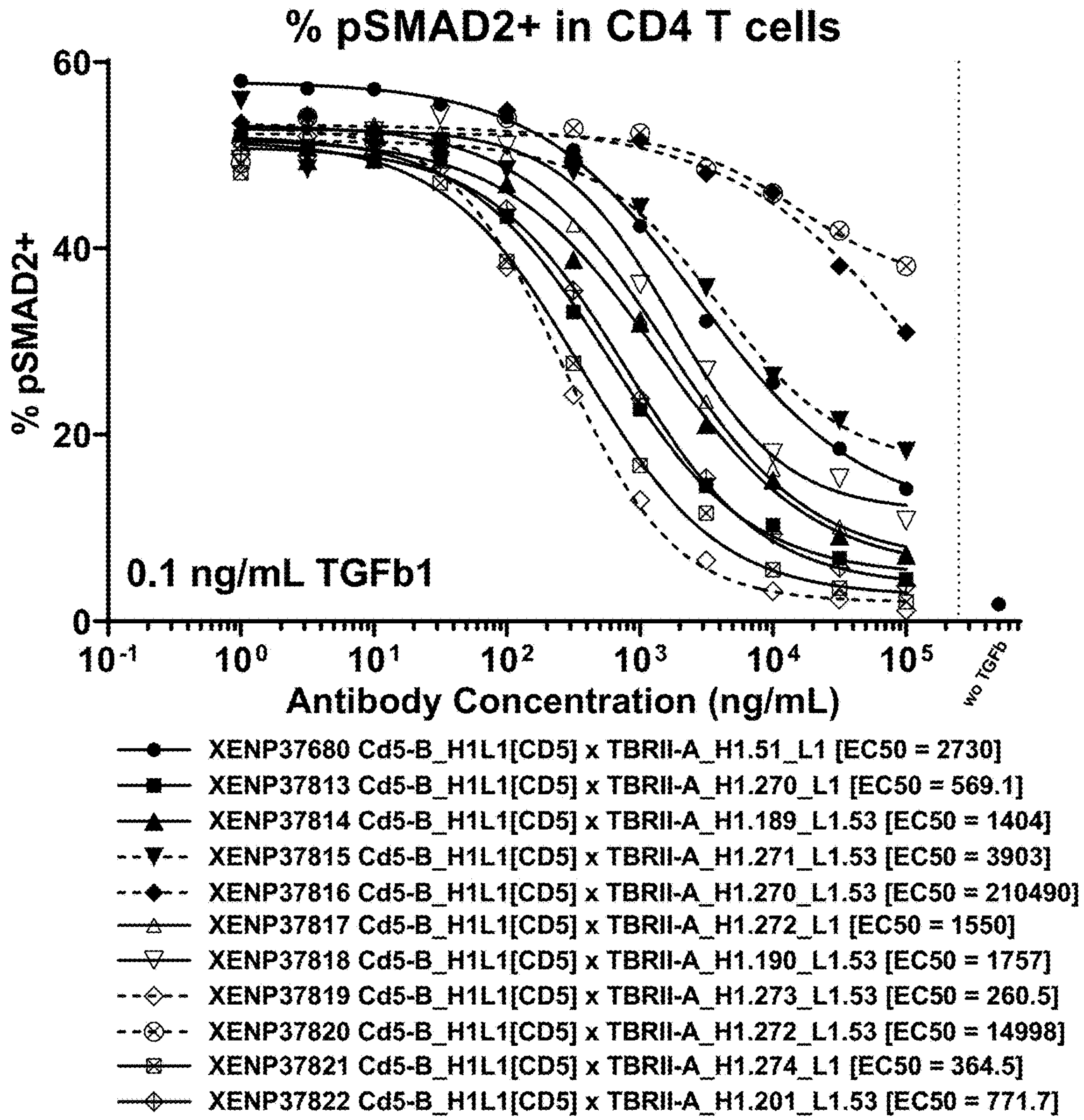

FIG. 78 depicts suppression of TGFßR1-induced SMAD2 phosphorylation in A) CD4 T cells αTGFßR2×αCD5 mAbs having humanized Cd5-B_H1L1 CD5 binding domain and stability-optimized TGFßRII binding domains having a range of TGFßRII binding affinities.

Figure 79A:
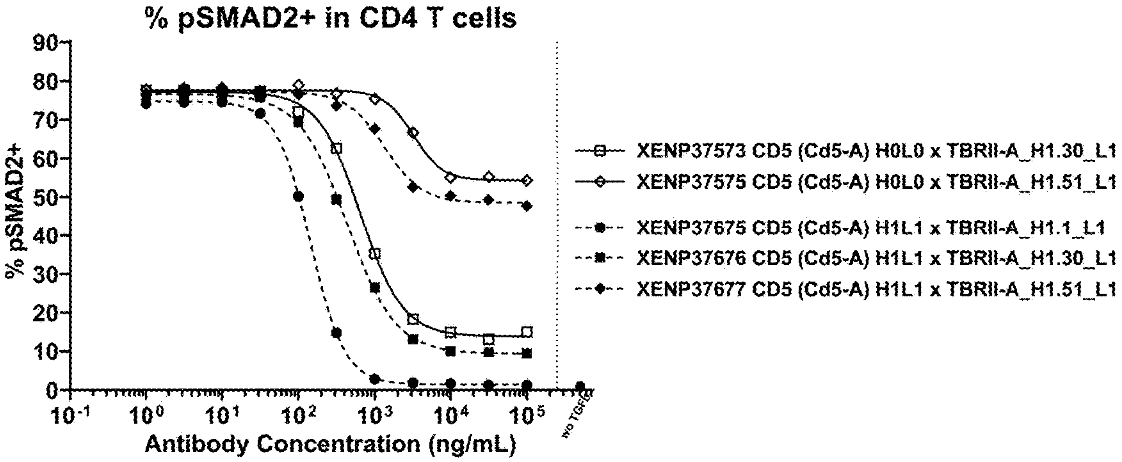
Figure 79B:
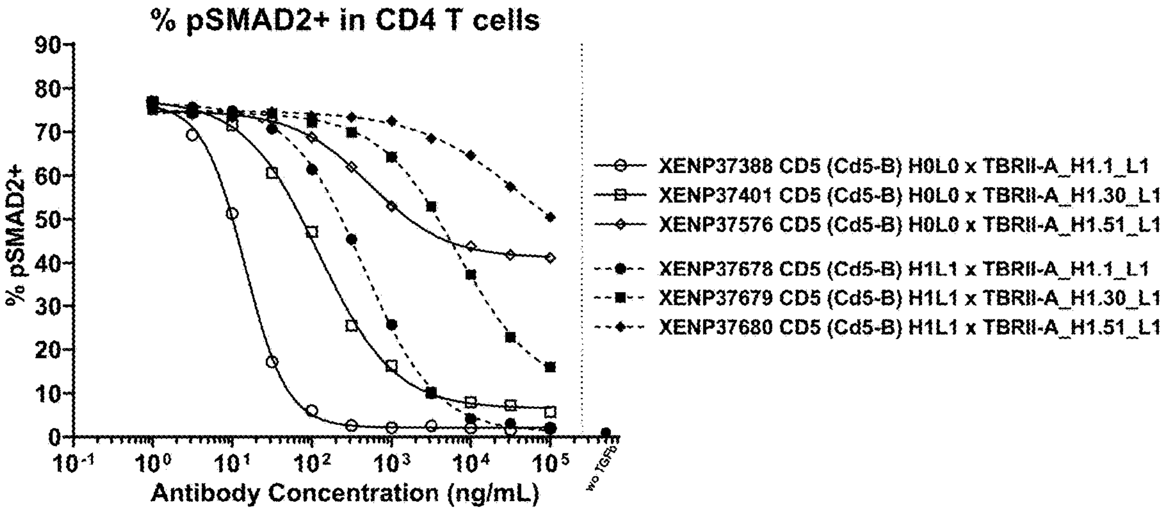

FIGS. 79A and 79B depict suppression of TGFßR1-induced SMAD2 phosphorylation in CD4+ T cells by αTGFßR2×αCD5 mAbs having A) murine vs. humanized Cd5-A binding domains and B) murine vs. humanized Cd5-B binding domains. The data show that humanization of Cd5-A resulted in enhanced suppression potency while humanization of Cd5-B resulted in reduced suppression potency.

Figure 80:
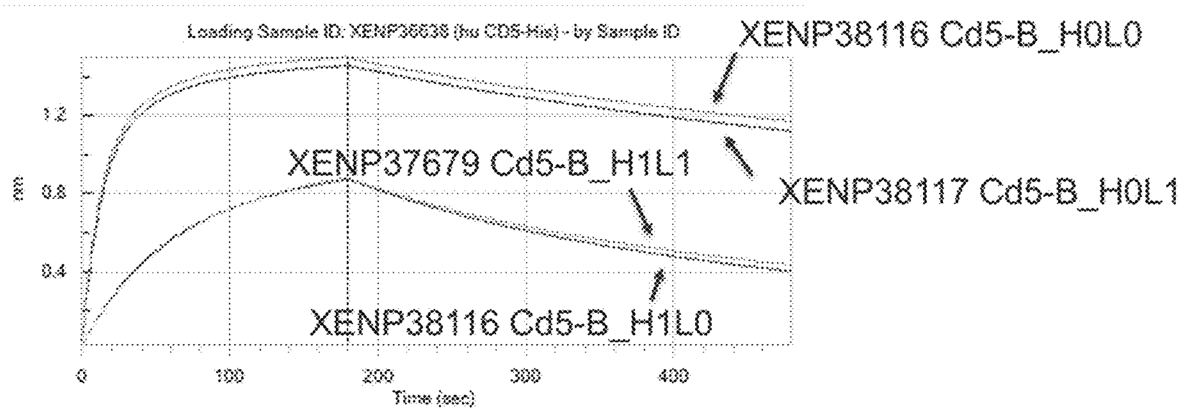

FIG. 80 depicts Octet sensorgrams of αTGFßRII×αCD5 having murine, H1L1 humanized, and half-humanized (i.e. humanized VH+murine VL–H1L0 and murine VH+humanized VL–H0L1) Cd5-B Fvs binding to human CD5.

Figure 81:
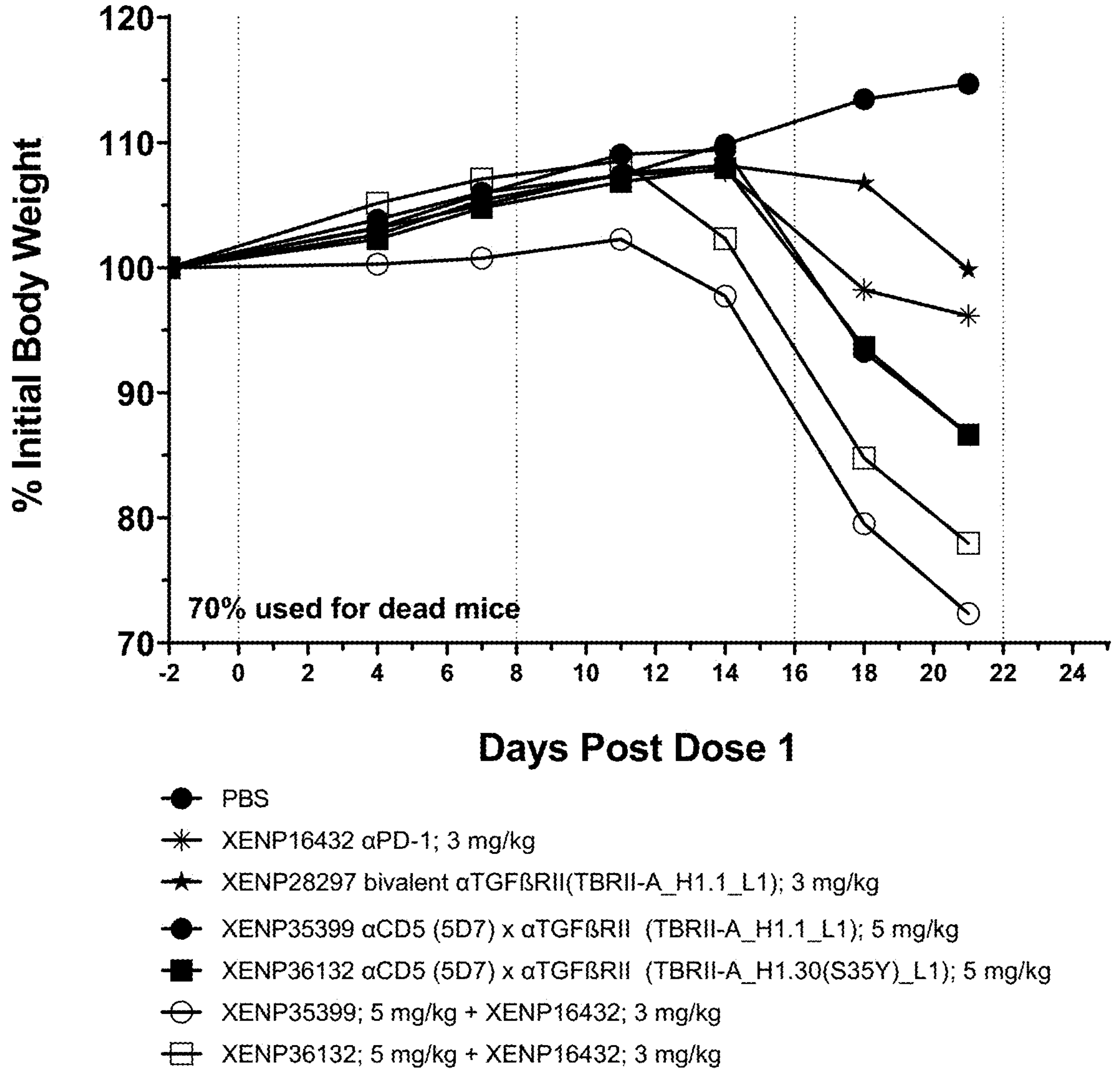

FIG. 81 depicts the change in body weight (relative to initial body weight) over time in huPBMC-engrafted NSG mice dosed with PBS control, XENP16432 (a bivalent anti-PD1 mAb based on nivolumab with PVA_S267K; a checkpoint inhibitor which enhances GVHD by de-repressing the engrafted human T cells), anti-TGFßRII mAb XENP28297 (clone TBRII-A_H1.1_L1), prototype anti-TGFßRII×anti-CD5 mAb XENP35399 alone or in combination with XENP16432, and TGFßRII affinity-reduced anti-TGFßRII×anti-CD5 mAb XENP36132 alone or in combination with XENP16432 on Days 0, 8, and 16. The data show that both XENP35399 and XENP36132 enhanced GVHD in comparison to PD-1 blockade alone or TGFßRII blockade alone. Notably, adding PD-1 blockade to the anti-TGFßRII×anti-CD5 bsAbs of the invention further enhances GHVD indicating productive combination with PD-1 blockade.

Figure 82A:
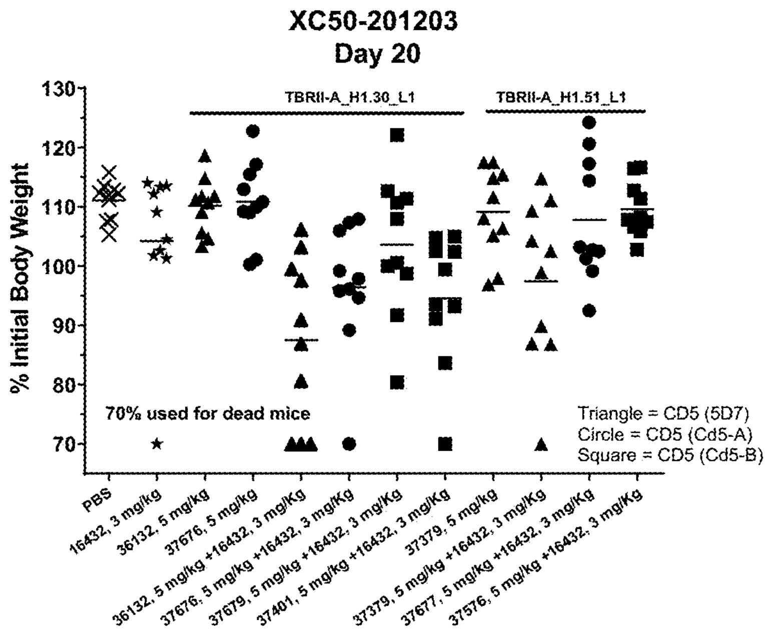
Figure 82B:
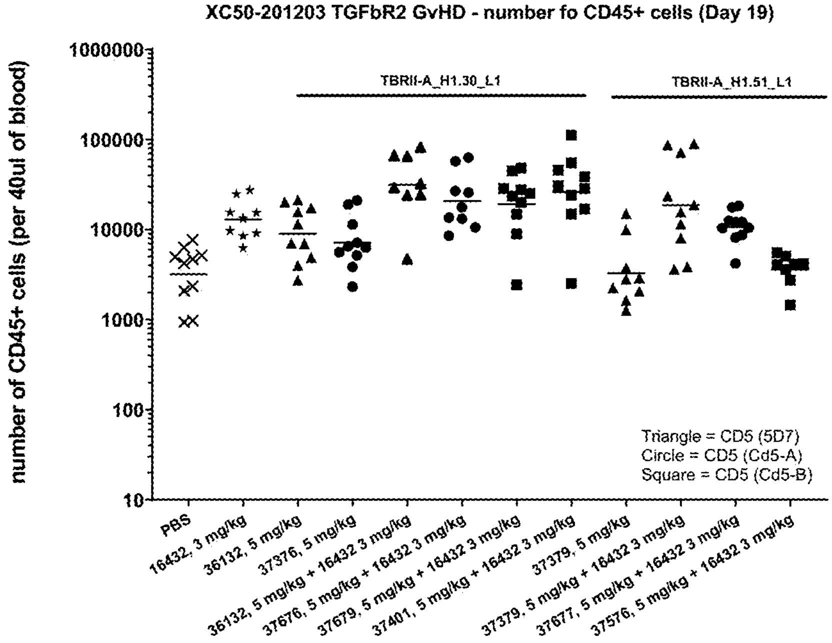
Figure 85A:
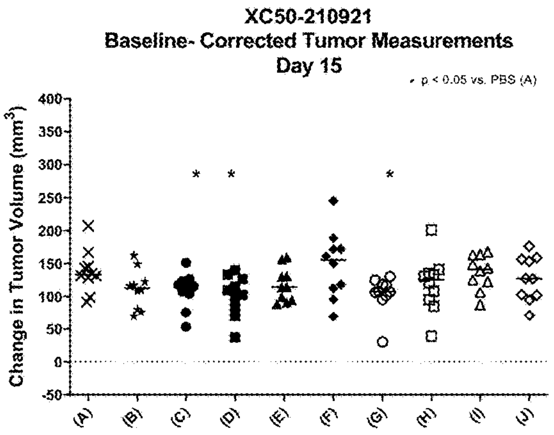
Figure 85B:
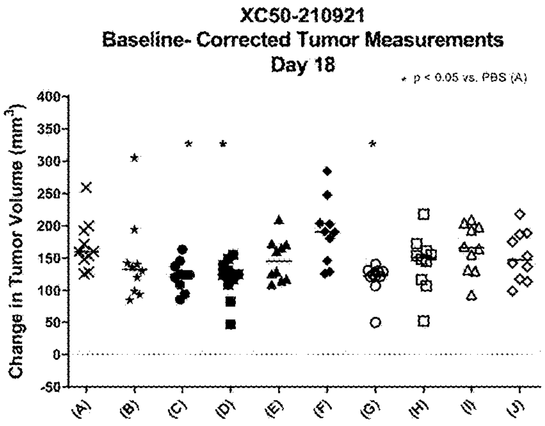
Figure 85C:
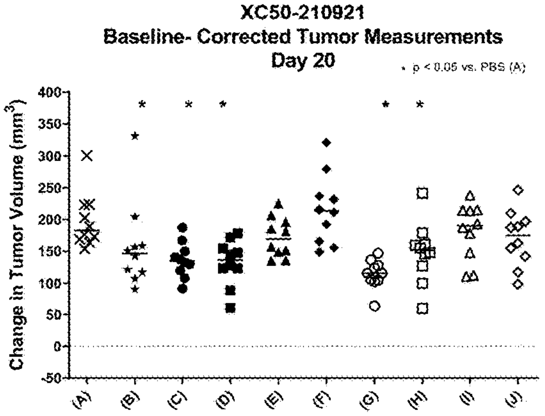
Figure 85D:
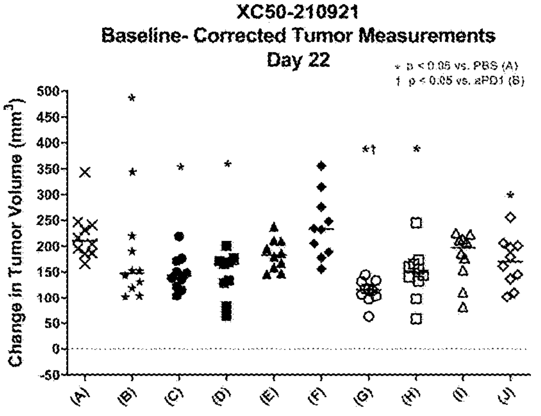
Figure 85E:
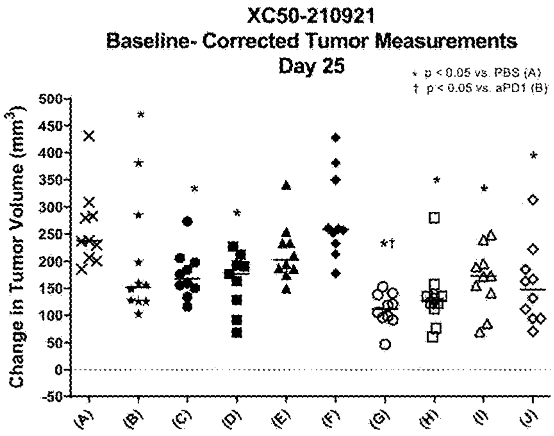
Figure 85F:
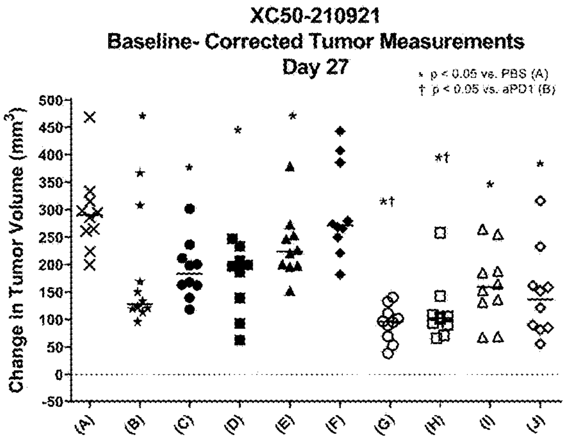
Figure 85G:
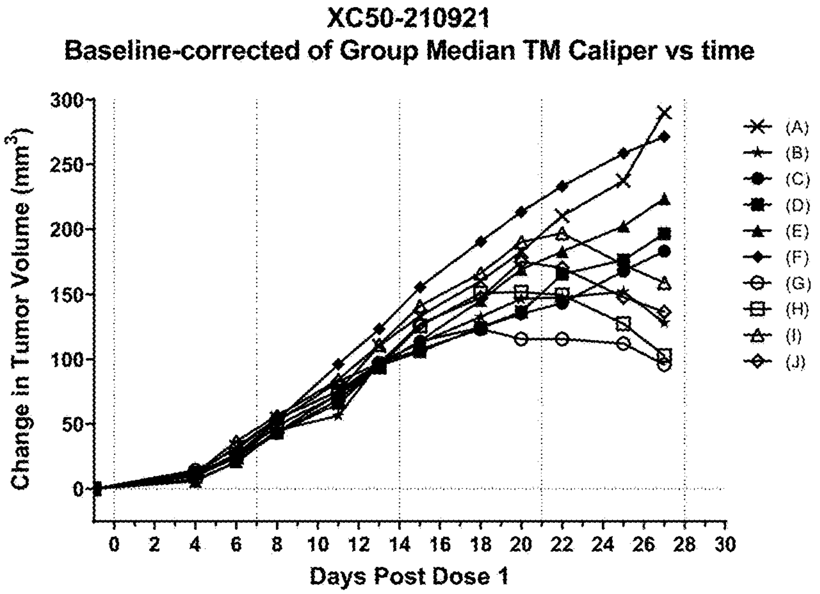

FIGS. 82A and 82B depict A) change in body weight (relative to initial body weight) on Day 20 and B) human CD45+ cell count in huPBMC-engrafted NSG mice dosed with PBS control, XENP16432, various αTGFßRII×αCD5 bsAbs having TBRII-A_H1.30_L1 or TBRII-A_H1.51_L1 binding domain and 5D7, Cd5-A, or Cd5-B binding domain alone or in combination with PD-1 blockade (XENP16432).

FIGS. 83A-83D depict A) CD45, B) CD3 T cell, C) CD4 T cell, and D) CD8 T cell counts on Day 7 in MDA-MB231 and huPBMC-engrafted DKO-NSG mice after treatment with anti-TGFßRII×anti-CD5 affinity-fixed humanized Cd5-B and either TBRII-A_H1.201_L1 or TBRII-A_H1.212_L1 binding domains alone or in combination with PD-1 blockade (XENP16432). The data show that by Day 7, XENP40323 having higher affinity TGFßRII binding domain (TBRII-A_H1.201_L1) significantly enhanced expansion of various lymphocyte populations over PBS control as a single agent. Further, both XENP40323 as well as XENP39131 having lower affinity TGFßRII binding domain (TBRII-A_H1.212_L1) in combination with PD-1 blockade significantly enhanced expansion of various lymphocyte populations over PBS control as well as anti-PD-1 as a single agent.

FIGS. 84A-84D depict A) CD45, B) CD3 T cell, C) CD4 T cell, and D) CD8 T cell counts on Day 14 in MDA-MB231 and huPBMC-engrafted DKO-NSG mice after treatment with anti-TGFßRII×anti-CD5 affinity-fixed humanized Cd5-B and either TBRII-A_H1.201_L1 or TBRII-A_H1.212_L1 binding domains alone or in combination with PD-1 blockade (XENP16432). The data show that by Day 14, both XENP40323 having higher affinity TGFßRII binding domain (TBRII-A_H1.201_L1) and XENP39131 having lower affinity TGFßRII binding domain (TBRII-A_H1.212_L1) enhanced expansion of various lymphocyte populations over PBS control as a single agent and in combination with PD-1 blockade.

FIGS. 85A-85G depict baseline corrected tumor measurements on A) Day 15, B) Day 18, C) Day 20, D) Day 22, E) Day 25, F) Day 27, and G) over time in MDA-MB231 and huPBMC-engrafted DKO-NSG mice after treatment with anti-TGFßRII×anti-CD5 affinity-fixed humanized Cd5-B and either TBRII-A_H1.201_L1 or TBRII-A_H1.212_L1 binding domains alone or in combination with PD-1 blockade (XENP16432). The data show that by Day 15, both XENP40323 having higher affinity TGFßRII binding domain (TBRII-A_H1.201_L1) and XENP39131 having lower affinity TGFßRII binding domain (TBRII-A_H1.212_L1) enhanced anti-tumor activity over PBS control. By Day 22, XENP40323 in combination with PD-1 blockade significantly enhanced anti-tumor activity over PD-1 blockade alone; and by Day 27, XENP39131 in combination with PD-1 blockade also enhanced anti-tumor activity over PD-1 blockade alone.

FIG. 86 depicts the sequences for PD-1 for both human and cynomolgus monkey to facilitate the development of antigen binding domains that bind to both for ease of clinical development.

FIGS. 87A and 87B depict consensus framework regions (FR) and complementarity determining regions (CDRs) (as in Kabat) for anti-TGFßRII clone TBRII-A variable heavy and variable light domain variants. In some embodiments, the TGFßRII binding domain includes any one of the sequences in FIGS. 87A and 87B.

FIGS. 88A and 88B depict consensus framework regions (FR) and complementarity determining regions (CDRs) (as in Kabat) for humanized anti-CD5 clone Cd5-B variable heavy and variable light domain variants. In some embodiments, the CD5 binding domain includes any one of the sequences in FIGS. 88A and 88B.

FIGS. 89A and 89B depict sequences for A) stability and/or affinity-optimized TBRII-A based VH which may be paired with the TBRII-A VL in B) or any other TBRII-A VL described herein. In some embodiments, the TGFßRII binding domain includes any one of the sequences in FIGS. 89A and 89B.

FIGS. 90A-90D depict A) CD45, B) CD3 T cell, C) CD4 T cell, and D) CD8 T cell counts on Day 21 in MDA-MB231 and huPBMC-engrafted DKO-NSG mice after treatment with anti-TGFßRII×anti-CD5 affinity-fixed humanized Cd5-B and either TBRII-A_H1.201_L1 or TBRII-A_H1.212_L1 binding domains alone or in combination with PD-1 blockade (XENP16432). The data show that by Day 14, both XENP40323 having higher affinity TGFßRII binding domain (TBRII-A_H1.201_L1) and XENP39131 having lower affinity TGFßRII binding domain (TBRII-A_H1.212_L1) in combination with PD-1 blockade enhanced expansion of CD8 T cells over PD-1 blockade alone.

Figure 91A:
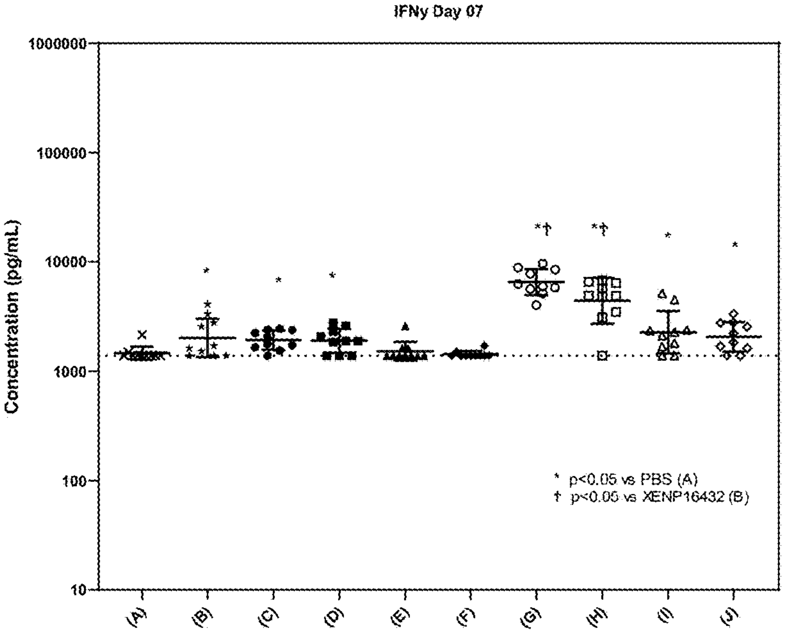
Figure 91B:
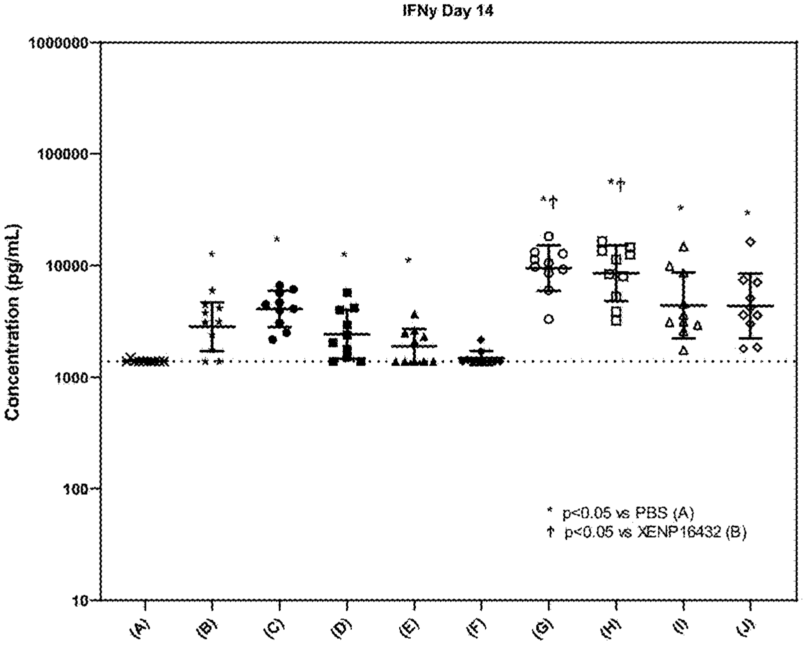

FIGS. 91A and 91B depict serum IFNγ levels on A) Day 7 and B) Day 14 in MDA-MB231 and huPBMC-engrafted DKO-NSG mice after treatment with anti-TGFßRII×anti-CD5 affinity-fixed humanized Cd5-B and either TBRII-A_H1.201_L1 or TBRII-A_H1.212_L1 binding domains alone or in combination with PD-1 blockade (XENP16432). The data show that by Day 7, both XENP40323 having higher affinity TGFßRII binding domain (TBRII-A_H1.201_L1) and XENP39131 having lower affinity TGFßRII binding domain (TBRII-A_H1.212_L1) enhanced IFNγ secretion over PBS control; further, both bsAbs in combination with PD-1 blockade enhanced IFNγ secretion over PD-1 blockade alone.

FIG. 92. Each of the sequences herein can be produced with or without M428L/N434S Xtend variant for enhanced FcRn binding and improved serum half-life. Illustrative such Xtend analogs for XENP40323 and XENP39131 are depicted here as XENP40323Xtend and XENP39131Xtend.

DETAILED DESCRIPTION OF THE INVENTION

A. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 3, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

As used herein, term "antibody" is used generally. Antibodies described herein can take on a number of formats as described herein, including traditional antibodies as well as antibody derivatives, fragments and mimetics, described herein.

Traditional immunoglobulin (Ig) antibodies are "Y" shaped tetramers. Each tetramer is typically composed of two identical pairs of polypeptide chains, each pair having one "light chain" monomer (typically having a molecular weight of about 25 kDa) and one "heavy chain" monomer (typically having a molecular weight of about 50-70 kDa).

Other useful antibody formats include those outlined herein and depicted in FIGS. 14 and 15 and as more fully outlined below.

Antibody heavy chains typically include a variable heavy (VH) domain, which includes vhCDR1-3, and an Fc domain, which includes a CH2-CH3 monomer. In some embodiments, antibody heavy chains include a hinge and CH1 domain. Traditional antibody heavy chains are monomers that are organized, from N- to C-terminus: VH-CH1-hinge-CH2-CH3. The CH1-hinge-CH2-CH3 is collectively referred to as the heavy chain "constant domain" or "constant region" of the antibody, of which there are five different categories or "isotypes": IgA, IgD, IgG, IgE and IgM. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the antibodies described herein include the use of human IgG1/G2 hybrids.

In some embodiments, the antibodies provided herein include IgG isotype constant domains, which has several subclasses, including, but not limited to IgG1, IgG2, IgG3, and IgG4. In the IgG subclass of immunoglobulins, there are several immunoglobulin domains in the heavy chain. By "immunoglobulin (Ig) domain" herein is meant a region of an immunoglobulin having a distinct tertiary structure. Of interest in the antibodies described herein are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype. It should be understood that therapeutic antibodies can also comprise hybrids of isotypes and/or subclasses. For example, as shown in US Publication 2009/0163699, incorporated by reference, the present antibodies, in some embodiments, include IgG1/IgG2 hybrids.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well. Many of the antibodies herein have at least one cysteine at position 220 according to EU numbering (hinge region) replaced by a serine. Generally, this modification is on the "scFv monomer" side for most of the sequences depicted herein, although it can also be on the "Fab monomer" side, or both, to reduce disulfide formation. Specifically included within the sequences herein are one or both of these cysteines replaced (C220S).

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

| | EU Numbering | Kabat Numbering |
|---|---|---|
| CH1 | 118-215 | 114-223 |
| Hinge | 216-230 | 226-243 |
| CH2 | 231-340 | 244-360 |
| CH3 | 341-447 | 361-478 |

The antibody light chain generally comprises two domains: the variable light domain (VL), which includes light chain CDRs vlCDR1-3, and a constant light chain region (often referred to as CL or Cκ). The antibody light chain is typically organized from N- to C-terminus: VL-CL.

By "antigen binding domain" or "ABD" herein is meant a set of Complementary Determining Regions (CDRs) that, when present as part of a polypeptide sequence, specifically binds a target antigen (e.g., CD5 or TGFßRII) as discussed herein. As discussed herein, there are two types of ABDs that find use in the present invention, those that use a set of 6 CDRs and those that rely on a set of three, in the case of VHH ABDs as more fully discussed herein.

Many ABDs rely on a set of 6 CDRs, which are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 variable heavy CDRs and vlCDR1, vlCDR2 and vlCDR3 vhCDR3 variable light CDRs. The CDRs are present in the variable heavy domain (vhCDR1-3) and variable light domain (vlCDR1-3). The variable heavy domain and variable light domain from an Fv region.

The antibodies described herein provide a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., *Dev. Comp. Immunol.* 27(1):55-77 (2003):

TABLE 2

| | Kabat+ Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In some embodiments, as outlined herein, a single domain antibody (sdAb, also referred to herein as "sdABD" or "VHH ABDs") that contains only a single variable heavy domain (referred to herein as "VHH") with three CDRs: VHHCDR1, VHHCDR2 and VHHCDR3.

Under either a VHH or standard VH and VL embodiment, the CDRs contribute to the formation of the antigen-binding, or more specifically, epitope binding site of the antigen binding domains and antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the disclosure not only includes the enumerated antigen binding domains and antibodies herein, but those that compete for binding with the epitopes bound by the enumerated antigen binding domains.

In some embodiments, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g., from FIGS. 14 and 15). In general, the C-terminus of the scFv domain is attached to the N-terminus of the hinge in the second monomer.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (VHCDR1, VHCDR2 and VHCDR3 for the variable heavy domain and VLCDR1, VLCDR2 and VLCDR3 for the variable light domain) and four framework (FR) regions, arranged from amino-terminus to carboxy-terminus in the following order: FR1-CDR1-FR2-CDR2-FR3-CDR3-FR4. The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991)

and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDR numbering of the invention are described in Table 2.

By "single domain Fv", "sdFv" or "sdABD" herein is meant an antigen binding domain that only has three CDRs, generally based on camelid antibody technology. See Protein Engineering 9(7):1129-35 (1994); Rev Mol Biotech 74:277-302 (2001); Ann Rev Biochem 82:775-97 (2013).

By "Fab" or "Fab region" as used herein is meant the polypeptide that comprises the VH, CH1, VL, and CL immunoglobulin domains, generally on two different polypeptide chains (e.g., VH-CH1 on one chain and VL-CL on the other). Fab may refer to this region in isolation, or this region in the context of a bispecific antibody described herein. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the VL and VH domains are combined (generally with a linker as discussed herein) to form an scFv. (In some cases, the Fv region is a sdABD, as appropriate herein).

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (VH-linker-VL or VL-linker-VH). In the sequences depicted in the sequence listing and in the figures, the order of the VH and VL domain is indicated in the name, e.g. H.X_L.Y means N- to C-terminal is VH-linker-VL, and L.Y_H.X is VL-linker-VH.

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233− or E233 #, E233( ) or E233del designates a deletion of glutamic acid at position 233. Additionally, EDA233− or EDA233 # designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST. "Variant" as used herein also refers to particular amino acid modifications that confer particular function (e.g., a "heterodimerization variant," "pI variant," "ablation variant," etc.).

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference).

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains described herein still retain the ability to form a dimer with another Fc domain as measured using known techniques as described herein, such as non-denaturing gel electrophoresis.

By "protein" herein is meant at least two covalently attached amino acids, which includes proteins, polypeptides, oligopeptides and peptides.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRT (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody.

By "strandedness" in the context of the monomers of the heterodimeric antibodies described herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the antibodies described herein is meant a cell that contains the exogeneous nucleic acids encoding the components of the bispecific antibody and is capable of expressing the bispecific antibody under suitable conditions. Suitable host cells are discussed below.

By "wild type or WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see blast.ncbi.nlm.nih.gov. When using any of the aforementioned algorithms, the default parameters (for Window length, gap penalty, etc.) are used. In one embodiment, sequence identity is done using the BLAST algorithm, using default parameters.

The antibodies described herein are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

B. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP33041, which is an anti-TGFßRII×anti-PD1 bsAb in the "1+1 Fab-scFv-Fc" format, as depicted in FIG. 14A, comprises three sequences (see FIG. 24) a "Fab-Fc Heavy Chain" monomer; 2) a "Fab-scFv-Fc Heavy Chain" monomer; and 3) a "Light Chain" monomer or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab includes, the full heavy chain sequence, the variable heavy domain sequence and the three CDRs of the variable heavy domain sequence, the full light chain sequence, a variable light domain sequence and the three CDRs of the variable light domain sequence. A Fab-scFv-Fc monomer includes a full length sequence, a variable heavy domain sequence, 3 heavy CDR sequences, and an scFv sequence (include scFv variable heavy domain sequence, scFv variable light domain sequence and scFv linker). Note that some molecules herein with a scFv domain use a single charged scFv linker (+H), although others can be used. In addition, the naming nomenclature of particular antigen binding domains (e.g., CD5, TGFßRII and PD-1 binding domains) use a "Hx.xx_Ly.yy" type of format, with the numbers being unique identifiers to particular variable chain sequences. Thus, the variable domain of the PD-1 binding domain for XENP33041 (see FIG. 24A) is "H1 L1.1", which indicates that the variable heavy domain, H1, was combined with the light domain L1.1. In the case that these sequences are used as scFvs, the designation "H1 L1", indicates that the variable heavy domain, H1 is combined with the light domain, L1, and is in VH-linker-VL orientation, from N- to C-terminus. This molecule with the identical sequences of the heavy and light variable domains but in the reverse order (VL-linker-VH orientation, from N- to C-terminus) would be designated "L1_H1". Similarly, different constructs may "mix and match" the heavy and light chains as will be evident from the sequence listing and the figures.

C. Introduction

Therapeutic antibodies directed against immune checkpoint inhibitors such as PD-1 are showing great promise in limited circumstances in the clinic for the treatment of cancer. Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells—especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy, Keytruda and Opdivo. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response.

Generally, these monoclonal antibodies bind to checkpoint inhibitor proteins such as CTLA-4 and PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

However, as discussed above, studies have shown that TILs commonly express multiple checkpoint receptors; this may suggest that single checkpoint blockade could be insufficient to promote a complete T cell response. Moreover, it is likely that TILs that express multiple checkpoints are in fact the most tumor-reactive, thus suggesting that therapies that engage more than one checkpoint antigen could be very useful.

Another mechanism by which tumors evade immune surveillance is by producing the immunosuppressive cytokine TGFß which directly inhibits the expression of cytolytic proteins such as IFNγ which are necessary for T cell-mediated tumor cytotoxicity. Additionally, TGFß is pro-fibrotic and promotes the expansion of fibroblasts. Cancer-associated fibroblasts (CAFs) have been reported to promote tumor survival and proliferation (Orimo et al., 2006; Xing et al., 2011), for example by providing growth factors for angiogenesis and by further encouraging an immunosuppressive environment, and have been associated with poor prognosis (Underwood et al, 2015).

Accordingly, the present invention provides bispecific heterodimeric antibodies, that bind to cells expressing the two antigens and methods of activating T cells and/or NK cells to treat diseases such as cancer and infectious diseases, and other conditions where increased immune activity results in treatment.

In some instances, it is beneficial to target TGFßRII blockade in broader cell populations. As described herein CD5 is a promiscuous cell-surface phosphatase that is expressed in many activated and unactivated T cells. Thus, bispecific heterodimeric antibodies that bind TGFßRII and CD5 can advantageously block TGFß activity in a broad population of cells, wherein such blockage of TGFß activity is desirable, for example, for the treatment of cancers.

Thus, the invention is directed, in some instances, to solving the issue of toxicity and expense of administering multiple antibodies by providing bispecific antibodies that bind to two different molecules on a single cell and advantageously requiring administration of only one therapeutic substance.

Bispecific antibodies, which can bind two different targets simultaneously, offer the potential to improve the selectivity of targeting particular cell types (e.g., high CD5+ cells or TILs), while also reducing cost of therapy. The bivalent interaction of an antibody with two targets on a cell surface should—in some cases—lead to a higher binding avidity relative to a monovalent interaction with one target at a time. Because of this, normal bivalent antibodies tend to have high avidity for their target on a cell surface. With bispecific antibodies, the potential exists to create higher selectivity for cells that simultaneously express two different targets, utilizing the higher avidity afforded by simultaneous binding to both targets.

Accordingly, the present invention is directed to novel constructs to provide heterodimeric antibodies that allow binding to more than one antigen or ligand, e.g. to allow for bispecific binding. The heterodimeric bispecific antibodies of the invention are useful to treat a variety of types of cancers. As will be appreciated by those in the art, in contrast to traditional monoclonal antibodies that bind to tumor antigens, or to the newer classes of bispecific antibodies that bind, for example, CD3 and tumor antigens (such as described in U.S. Ser. No. 15/141,350, for example), checkpoint antibodies are used to increase the immune response but are not generally tumor specific in their action. That is, the bispecific antibodies of the invention inhibit the suppression of the immune system, generally leading to T cell activation, which in turn leads to greater immune response to cancerous cells and thus treatment. Such antibodies can therefore be expected to find utility for treatment of a wide variety of tumor types. For example, the FDA recently approved Keytruda®, an anti-PD-1 monospecific antibody on the basis of a genetic feature, rather than a tumor type.

Additionally, the bispecific heterodimeric antibodies of the present invention that bind to TGFßRII and PD-1 can have two different functional components. In some embodiments, the anti-PD-1 antigen binding domain (ABD) competes for binding with approved anti-PD-1 antibodies such as nivolumab (OPDIVO®) and pembrolizumab (KEYTRUDA®); that is, the anti-PD-1 ABD of the bispecific antibody serves to prevent the binding of PD-1 to its cognate ligands such as PD-L1. That is, the anti-PD-1 ABD is used to both target T cells but also to block interaction with PD-1 ligands. In other embodiments, the anti-PD-1 ABD of the bispecific antibody serves only to target the bispecific antibody to the T cell and does not interfere with the association of PD-1 with its ligands; that is, it does not compete with nivolumab or permbrolizumab, and thus, in some embodiments, can be co-administered with a standard anti-PD-1 antibody such as nivolumab or permbrolizumab to give unexpectedly better results. Anti-PD-1 ABDs that do not compete are referred to herein as "non-competing PD-1 ABDs" or "NCPD-1 ABDs".

D. Heterodimeric Antibodies

Accordingly, in some embodiments the present invention provides heterodimeric immunomodulatory antibodies that rely on the use of two different heavy chain variant Fc sequences, that will self-assemble to form heterodimeric Fc domains and heterodimeric antibodies.

The present invention is directed to novel constructs to provide heterodimeric antibodies that allow binding to more than one immunomodulatory antigen or ligand, e.g. to allow for bispecific binding. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric immunomodulatory antibodies which can co-engage antigens in several ways, relying on amino acid variants in the constant regions that are different on each chain to promote heterodimeric formation and/or allow for ease of purification of heterodimers over the homodimers.

Thus, the present invention provides bispecific antibodies. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers. In some embodiments, the bispecific antibodies include a TGFßRII binding domain. Any suitable TGFßRII binding domain can be included in the bispecific antibody provided herein, including those disclosed in the Figures (e.g., FIGS. 19, 87 and 89) and the sequence listing. In some embodiments, the bispecific antibody includes a TGFßRII binding domain and a CD5 binding domain (i.e., an anti-TGFßRII×anti-CD5 antibody). Any suitable CD5 can be included in the anti-TGFßRII×anti-CD5 antibody including those disclosed in the Figures (e.g., FIGS. 61-63 and 88) and the sequence listing. In some embodiments, the bispecific antibody includes a TGFßRII binding domain and a PD-1 binding domain (i.e., an anti-TGFßRII×anti-PD-1 antibody). Any suitable PD-1 binding domain can be included in the anti-TGFßRII×anti-PD-1 bispecific antibody including those disclosed in the sequence listing.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (e.g. aspartic acid to lysine) or changing a charged residue to a neutral residue (e.g. loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A−+B or wt A−−B), or by increasing one region and decreasing the other region (A+−B− or A−B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies" by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein. Furthermore, as will be appreciated by those in the art and outlined herein, in some embodiments, heterodimers can be separated from homodimers on the basis of size. Several of the formats provided herein allow separation of heterodimers and homodimers on the basis of size.

1. Heterodimerization Variants

The present invention provides heterodimeric proteins, including heterodimeric antibodies in a variety of formats, which utilize heterodimeric variants to allow for heterodimeric formation and/or purification away from homodimers. A number of heterodimerization variants are shown in the Figures (e.g., FIGS. 1 and 4).

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25 homodimer A/A: 50% heterodimer A/B:25% homodimer B/B).

2. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the Figures.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in the Figures showing some pairs of particular utility in many embodiments. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L, K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q: L368D/K370S" means that one of the monomers has the double variant set S364K/E357Q and the other has the double variant set L368D/K370S; as above, the "strandedness" of these pairs depends on the starting pI.

3. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in the Figures. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the bottle opener format, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including $(GKPGS)_4$. However, as will be appreciated by those in the art, the first monomer includes a CH1 domain, including position 208. Accordingly, in constructs that do not include a CH1 domain (for example for heterodimeric Fc fusion proteins that do not utilize a CH1 domain on one of the domains, for example in a dual scFv format), a preferred negative pI variant Fc set includes 295E/384D/418E/421D variants (Q295E/N384D/Q418E/N421D when relative to human IgG1).

Accordingly, in some embodiments, one monomer has a set of substitutions from the Figures and the other monomer has a charged linker (either in the form of a charged scFv linker because that monomer comprises an scFv or a charged domain linker, as the format dictates).

4. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

5. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

6. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

7. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

8. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

9. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in the figures, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

10. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

E. CD5 Antigen Binding Domains

In one aspect, provided herein are antigen binding domains (ABDs) that bind CD5 (also referred to herein as "anti-CD5 antigen binding domains" or CD5 antigen binding domains" or "CD5 binding domains") and related antibodies that include such anti-CD5 binding domains (e.g., anti-CD5×anti-TGFßRII bispecific antibodies). The subject anti-CD5 binding domains described herein are capable of binding to CD5 expressing cells.

In some embodiments, antibodies that include the anti-CD5 antigen binding domains provided herein are capable of selectively binding to cells expressing high levels of CD5 over cells expressing low levels of CD5. In some embodiments, the antibodies that include such anti-CD5 antigen binding domains are useful in the treatment of cancers. For example, anti-CD5×anti-TGFßRII bispecific antibodies that include the subject anti-CD5 antigen binding domains find use as cancer therapeutics by blocking the TGFß/TGFßR axis in cells that express CD5. In particular embodiments, the subject anti-CD5×anti-TGFßRII bispecific antibodies are capable of enhancing blocking activity on both on activated and unactivated T cells.

As will be appreciated by those in the art, suitable anti-CD5 binding domains can include a set of 6 CDRs as depicted in the figures (FIGS. 61-63 and 88) and sequence listing, either as the CDRs are underlined or, in the case where a different numbering scheme is used as described herein and as shown in Table 2, as the CDRs that are identified using other alignments within the variable heavy (VH) domain and variable light domain (VL) sequences of those depicted in the figures (FIGS. 61-63 and 88) and sequence listing (see Table 2). Suitable anti-CD5 ABDs can also include the entire VH and VL sequences as depicted in these sequences and figures, used as scFvs or as Fab domains.

In one embodiment, the anti-CD5 antigen binding domain includes the 6 CDRs (i.e., vhCDR1-3 and vlCDR1-3) of an anti-CD5 antigen binding domain formed by any combination of an anti-CD5 VH and VL described herein, including the figures (FIGS. 61-63 and 88) and sequence listing. In exemplary embodiments, the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain is selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the variable heavy domain is selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and the variable light domain selected is from the group consisting of: SEQ ID NO:2175, SEQ ID NO:2167, SEQ ID NO:2191, SEQ ID NOs:1755-1757, SEQ ID NO:2151 and SEQ ID NO:2159.

In addition to the parental CDR sets disclosed in the figures and sequence listing that form an ABD to CD5, provided herein are variant anti-CD5 ABDS having CDRs that include at least one modification of the anti-CD5 ABD CDRs disclosed herein. In one embodiment, the anti-CD5 ABD includes a set of 6 CDRs with 1, 2, 3, 4, 5, 6, 7, 8, 9, 10 amino acid modifications as compared to the 6 CDRs of an anti-CD5 antigen binding domain formed by any combination of an anti-CD5 variable heavy (VH) domain and variable light (VL) domain described herein, including the figures (FIGS. 61-63 and 88) and sequence listing. In exemplary embodiments, the anti-CD5 ABD includes a set of 6 CDRs with 1, 2, 3, 4, 5, 6, 7, 8, 9, 10 amino acid modifications as compared to the 6 CDRs of an anti-CD5 antigen binding domain formed by any combination of an anti-CD5 variable heavy (VH) domain and variable light (VL) domain described herein, wherein the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain is selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the anti-CD5 ABD includes a set of 6 CDRs with 1, 2, 3, 4, 5, 6, 7, 8, 9, 10 amino acid modifications as compared to the 6 CDRs of an anti-CD5 antigen binding domain formed by any combination of an anti-CD5 described herein, wherein the variable heavy domain is selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and the variable light domain selected is from the group consisting of: SEQ ID NO:2175, SEQ ID NO:2167, SEQ ID NO:2191, SEQ ID NOs:1755-1757, SEQ ID NO:2151 and SEQ ID NO:2159. In certain embodiments, the variant anti-CD5 ABD is capable of binding CD5 antigen, as measured by at least one of a Biacore, surface plasmon resonance (SPR) and/or BLI (biolayer interferometry, e.g., Octet assay) assay, with the latter finding particular use in many embodiments. In particular embodiments, the anti-CD5 ABD is capable of binding human CD5.

In one embodiment, the anti-CD5 ABD includes 6 CDRs that are at least 90, 95, 97, 98 or 99% identical to the 6 CDRs of an anti-CD5 antigen binding domain formed by any combination of an anti-CD5 variable heavy (VH) domain and variable light (VL) domain described herein, including the figures (FIGS. 61-63 and 88) and sequence listing. In exemplary embodiments, the anti-CD5 ABD includes 6 CDRs that are at least 90, 95, 97, 98 or 99% identical to the 6 CDRs of an anti-CD5 antigen binding domain formed by a combination of an anti-CD5 variable heavy (VH) domain and variable light (VL) domain described herein, wherein the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain is selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the anti-CD5 ABD includes 6 CDRs that are at least 90, 95, 97, 98 or 99% identical to the 6 CDRs of an anti-CD5 antigen binding domain formed by a combination of an anti-CD5 variable heavy (VH) domain and variable light (VL) domain described herein, wherein the variable heavy domain is selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and the variable light domain selected is from the group consisting of: SEQ ID NO:2175, SEQ ID NO:2167, SEQ ID NO:2191, SEQ ID NOs:1755-1757, SEQ ID NO:2151 and SEQ ID NO:2159. In certain embodiments, the anti-CD5 ABD is capable of binding to CD5 antigen, as measured by at least one of a Biacore, surface plasmon resonance (SPR) and/or BLI (biolayer interferometry, e.g., Octet assay) assay, with the latter finding particular use in many embodiments. In particular embodiments, the anti-CD5 ABD is capable of binding human CD5.

In another exemplary embodiment, the anti-CD5 ABD include the variable heavy (VH) domain and variable light (VL) domain of any one of the anti-CD5 VH domains and VL domains described herein, including the figures (FIGS. 61-63 and 88) and sequence listing. In exemplary embodiments, the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain is selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the variable heavy domain is selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and the variable light domain selected is from the group consisting of: SEQ ID NO:2175, SEQ ID NO:2167, SEQ ID NO:2191, SEQ ID NOs:1755-1757, SEQ ID NO:2151 and SEQ ID NO:2159.

In addition to the parental anti-CD5 binding domain variable heavy and variable light domains disclosed herein, provided herein are anti-CD5 ABDs that include a variable heavy domain and/or a variable light domain that are variants of an anti-CD5 ABD variable heavy (VH) domain and variable light (VL) domain disclosed herein. In one embodiment, the variant VH domain and/or VL domain has from 1, 2, 3, 4, 5, 6, 7, 8, 9 or 10 amino acid changes from a VH and/or VL domain of an anti-CD5 variable heavy (VH) domain and variable light (VL) domain described herein, including the figures (FIGS. 61-63 and 88) and sequence listing. In exemplary embodiments, the variant VH domain and/or VL domain has from 1, 2, 3, 4, 5, 6, 7, 8, 9 or 10 amino acid changes from a VH and/or VL domain, wherein the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the variant VH domain and/or VL domain has from 1, 2, 3, 4, 5, 6, 7, 8, 9 or 10 amino acid changes from a VH and/or VL domain, wherein the variable heavy domain is selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and the variable light domain is selected from the group consisting of: SEQ ID NO:2175, SEQ ID NO:2167, SEQ ID NO:2191, SEQ ID NOs:1755-1757, SEQ ID NO:2151 and SEQ ID NO:2159. In certain embodiments, the anti-CD5 ABD is capable of binding to CD5, as measured at least one of a Biacore, surface plasmon resonance (SPR) and/or BLI (biolayer interferometry, e.g., Octet assay) assay, with the latter finding particular use in many embodiments. In particular embodiments, the anti-CD5 ABD is capable of binding human CD5.

In one embodiment, the variant VH and/or VL domain is at least 90, 95, 97, 98 or 99% identical to the VH and/or VL of an anti-CD5 ABD as described herein, including the figures (FIGS. 61-63 and 88) and sequence listing. In exemplary embodiments, the variant VH and/or VL domain is at least 90, 95, 97, 98 or 99% identical to a VH and/or VL, wherein the variable heavy domain is selected from the group consisting of: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, and the variable light domain selected from the group consisting of: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141. In exemplary embodiments, the variant VH and/or VL domain is at least 90, 95, 97, 98 or 99% identical to a VH and/or VL of a variable heavy domain selected from the group consisting of: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, and/or a variable light domain selected is from the group consisting of: SEQ ID NO:2175, SEQ ID NO:2167, SEQ ID NO:2191, SEQ ID NOs:1755-1757, SEQ ID NO:2151 and SEQ ID NO:2159. In certain embodiments, the anti-CD5 ABD is capable of binding to CD5, as measured by at least one of a Biacore, surface plasmon resonance (SPR) and/or BLI (biolayer interferometry, e.g., Octet assay) assay, with the latter finding particular use in many embodiments. In particular embodiments, the anti-CD5 ABD is capable of binding human CD5.

Such CD5 binding domains can be included in any of the heterodimeric antibodies provided herein including, for example, the "1+1 Fab-scFv-Fc," "1+1 Fab-VHH-Fc," "1+1 VHH-scFv-Fc," "2+1 $Fab_2$-scFv-Fc," and "2+1 $Fab_2$-VHH-Fc" format antibodies disclosed herein.

F. Anti-TGFßRII Antigen Binding Domains

Provided herein are antigen binding domains that bind TGFßRII (also referred to herein as "anti-TGFßRII antigen binding domains" or "TGFßRII antigen binding domains") and variants thereof, as well as related antibodies that include such anti-TGFßRII binding domains (e.g., anti-CD5×anti-TGFßRII bispecific antibodies and anti-PD-1× anti-TGFßRII bispecific antibodies). As outlined herein, there are two different types of anti-TGFßRII ABDs, those that contain a VH and VL and those that are VHH domains and only contain a single heavy variable domain.

Anti-TGFßRII ABD variable heavy and variable light domains are depicted in FIGS. 19, 87, 89 and the sequence listing. Anti-TGFßRII ABDs that include a single VHH are included in the sequence listing (SEQ ID NOs:580-939).

As will be appreciated by those in the art, suitable anti-TGFßRII binding domains can include a set of 6 CDRs as depicted in the figures (FIGS. 19, 87, 89) and sequence listing, either as the CDRs are underlined or, in the case where a different numbering scheme is used as described herein and as shown in Table 2, as the CDRs that are identified using other alignments within the variable heavy (VH) domain and variable light domain (VL) sequences of those depicted in the figures (FIGS. 19, 87, 89) and sequence listing (see Table 2). Suitable anti-TGFßRII ABDs can also include the entire VH and VL sequences as depicted in these sequences and figures, used as scFvs or as Fab domains.

In one embodiment, the anti-TGFßRII antigen binding domain includes the 6 CDRs (i.e., vhCDR1-3 and vlCDR1-3) of an anti-TGFßRII antigen binding domain formed by any combination of an anti-TGFßRII VH and VL described herein, including the figures (FIGS. 19, 87, 89) and sequence listing. In exemplary embodiments, the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain is selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the variable heavy domain is selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain selected is from the group consisting of: SEQ ID NO:1867, SEQ ID NO:1879, and SEQ ID NOs:1606-1703.

In addition to the parental CDR sets disclosed in the figures and sequence listing that form an ABD to TGFßRII, provided herein are variant anti-TGFßRII ABDS having CDRs that include at least one modification of the anti-TGFßRII ABD CDRs disclosed herein. In one embodiment, the anti-TGFßRII ABD includes a set of 6 CDRs with 1, 2, 3, 4, 5, 6, 7, 8, 9, 10 amino acid modifications as compared to the 6 CDRs of an anti-TGFßRII antigen binding domain formed by any combination of an anti-TGFßRII variable heavy (VH) domain and variable light (VL) domain described herein, including the figures (FIGS. 19, 87, 89) and sequence listing. In exemplary embodiments, the anti-TGFßRII ABD includes a set of 6 CDRs with 1, 2, 3, 4, 5, 6, 7, 8, 9, 10 amino acid modifications as compared to the 6 CDRs of an anti-TGFßRII antigen binding domain formed by any combination of an anti-TGFßRII variable heavy (VH) domain and variable light (VL) domain described herein, wherein the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain is selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the anti-TGFßRII ABD includes a set of 6 CDRs with 1, 2, 3, 4, 5, 6, 7, 8, 9, 10 amino acid modifications as compared to the 6 CDRs of an anti-TGFßRII antigen binding domain formed by any combination of an anti-TGFßRII variable heavy (VH) domain and variable light (VL) domain described herein, wherein the variable heavy domain is selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain selected is from the group consisting of: SEQ ID NO:1867, SEQ ID NO:1879, and SEQ ID NOs:1606-1703. In certain embodiments, the variant anti-TGFßRII ABD is capable of binding TGFßRII antigen, as measured by at least one of a Biacore, surface plasmon resonance (SPR) and/or BLI (biolayer interferometry, e.g., Octet assay) assay, with the latter finding particular use in many embodiments. In particular embodiments, the anti-TGFßRII ABD is capable of binding human TGFßRII.

In one embodiment, the anti-TGFßRII ABD includes 6 CDRs that are at least 90, 95, 97, 98 or 99% identical to the 6 CDRs of an anti-TGFßRII antigen binding domain formed by any combination of an anti-TGFßRII variable heavy (VH) domain and variable light (VL) domain described herein, including the figures (FIGS. 19, 87, 89) and sequence listing. In exemplary embodiments, the anti-TGFßRII ABD includes 6 CDRs that are at least 90, 95, 97, 98 or 99% identical to the 6 CDRs of an anti-TGFßRII antigen binding domain formed by a combination of an anti-TGFßRII variable heavy (VH) domain and variable light (VL) domain described herein, wherein the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain is selected from the group consisting of: SEQ ID NO:1867, SEQ ID NO:1879, and SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the anti-TGFßRII ABD includes 6 CDRs that are at least 90, 95, 97, 98 or 99% identical to the 6 CDRs of an anti-TGFßRII antigen binding domain formed by a combination of an anti-TGFßRII variable heavy (VH) domain and variable light (VL) domain described herein, wherein the variable heavy domain is selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain selected is from the group consisting of: SEQ ID NO:1867, SEQ ID NO:1879, and SEQ ID NOs:1606-1703. In certain embodiments, the anti-TGFßRII ABD is capable of binding to TGFßRII antigen, as measured by at least one of a Biacore, surface plasmon resonance (SPR) and/or BLI (biolayer interferometry, e.g., Octet assay) assay, with the latter finding particular use in many embodiments. In particular embodiments, the anti-TGFßRII ABD is capable of binding human TGFßRII.

In another exemplary embodiment, the anti-TGFßRII ABD include the variable heavy (VH) domain and variable light (VL) domain of any one of the anti-TGFßRII VH domains and VL domains described herein, including the figures (FIGS. 19, 87, 89) and sequence listing. In exemplary embodiments, the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain is selected from the group consisting of: SEQ ID NO:1867, SEQ ID NO:1879, SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the variable heavy domain is selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain selected is from the group consisting of: SEQ ID NO:1867, SEQ ID NO:1879, and SEQ ID NOs:1606-1703.

In addition to the parental anti-TGFßRII binding domain variable heavy and variable light domains disclosed herein, provided herein are anti-TGFßRII ABDs that include a variable heavy domain and/or a variable light domain that are variants of an anti-TGFßRII ABD variable heavy (VH) domain and variable light (VL) domain disclosed herein. In one embodiment, the variant VH domain and/or VL domain has from 1, 2, 3, 4, 5, 6, 7, 8, 9 or 10 amino acid changes from a VH and/or VL domain of an anti-TGFßRII variable heavy (VH) domain and variable light (VL) domain described herein, including the figures (FIGS. 19, 87, 89) and sequence listing. In exemplary embodiments, the variant VH domain and/or VL domain has from 1, 2, 3, 4, 5, 6, 7, 8, 9 or 10 amino acid changes from a VH and/or VL domain, wherein the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain selected from the group consisting of: SEQ ID NO:1867, SEQ ID NO:1879, SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the variant VH domain and/or VL domain has from 1, 2, 3, 4, 5, 6, 7, 8, 9 or 10 amino acid changes from a VH and/or VL domain, wherein the variable heavy domain is selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain is selected is from the group consisting of: SEQ ID NO:1867, SEQ ID NO:1879, and SEQ ID NOs:1606-1703. In certain embodiments, the anti-TGFßRII ABD is capable of binding to TGFßRII, as measured at least one of a Biacore, surface plasmon resonance (SPR) and/or BLI (biolayer interferometry, e.g., Octet assay) assay, with the latter finding particular use in many embodiments. In particular embodiments, the anti-TGFßRII ABD is capable of binding human TGFßRII.

In one embodiment, the variant VH and/or VL domain is at least 90, 95, 97, 98 or 99% identical to the VH and/or VL of an anti-TGFßRII ABD as described herein, including the figures (FIGS. 19, 87, 89) and sequence listing. In exemplary embodiments, the variant VH and/or VL domain is at least 90, 95, 97, 98 or 99% identical to a VH and/or VL, wherein the variable heavy domain is selected from the group consisting of: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310, and the variable light domain selected from the group consisting of: SEQ ID NO:1867, SEQ ID NO:1879, SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319. In exemplary embodiments, the variant VH and/or VL domain is at least 90, 95, 97, 98 or 99% identical to a VH and/or VL, wherein the variable heavy domain selected from the group consisting of: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, and the variable light domain selected is from the group consisting of: SEQ ID NO:1867, SEQ ID NO:1879, and SEQ ID NOs:1606-1703. In certain embodiments, the anti-TGFßRII ABD is capable of binding to TGFßRII, as measured by at least one of a Biacore, surface plasmon resonance (SPR) and/or BLI (biolayer interferometry, e.g., Octet assay) assay, with the latter finding particular use in many embodiments. In particular embodiments, the anti-TGFßRII ABD is capable of binding human TGFßRII.

Such TGFßRII binding domains can be included in any of the heterodimeric antibodies provided herein including, for example, the "1+1 Fab-scFv-Fc," "1+1 Fab-VHH-Fc," "1+1 VHH-scFv-Fc," "2+1 $Fab_2$-scFv-Fc," and "2+1 $Fab_2$-VHH-Fc" format antibodies disclosed herein.

G. Anti-PD-1 Antigen Binding Domains

The invention provides bispecific heterodimeric antibodies that bind to human PD-1, the sequence of which are depicted in the sequence listing. As outlined herein, there are two different types of anti-PD-1 ABDs, those that compete for binding with nivolumab and pembrolizumab (e.g. those that interfere with the binding of the PD-1 protein with its cognate functional ligands but target the antibody to the T cells), and those that do not compete (and thus can be co-administered with anti-PD-1 antibodies as well).

As will be appreciated by those in the art, there are a large number of suitable anti-PD-1 ABDs that bind human PD-1, including those depicted in the sequence listing. Additionally, these anti-PD-1 variable heavy (VH) domain and variable light (VL) domain domains can be utilized either as Fab constructs, or as scFv constructs. The VH/VL of competing PD-1 ABDs that are useful in the subject in the heterodimeric antibodies provided herein include, but are not limited to: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479 and variants thereof.

Alternatively, anti-PD-1 ABDs that bind human PD-1 but do not compete for binding with nivolumab and pembrolizumab, "NCPD-1 ABDs", can also be used in the present invention. Non-competing PD-1 ABDs that are useful in the subject in the heterodimeric antibodies provided herein include, but are not limited to, those that include a variable heavy domain selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123 or a variant thereof, and a variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127 or a variant thereof.

In one embodiment, the anti-PD-1 antigen binding domain includes the 6 CDRs (i.e., vhCDR1-3 and vlCDR1-3) of an anti-PD-1 antigen binding domain formed by any combination of an anti-PD-1 variable heavy (VH) domain and variable light (VL) domain described herein, including the sequence listing. In exemplary embodiments, the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain is selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the variable heavy domain and variable light domain are selected from the following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479.

In addition to the parental CDR sets disclosed in the figures and sequence listing that form an ABD to PD-1, provided herein are variant anti-PD-1 ABDS having CDRs that include at least one modification of the anti-PD-1 ABD CDRs disclosed herein. In one embodiment, the anti-PD-1 ABD includes a set of 6 CDRs with 1, 2, 3, 4, 5, 6, 7, 8, 9, 10 amino acid modifications as compared to the 6 CDRs of an anti-PD-1 antigen binding domain formed by any combination of an anti-PD-1 variable heavy (VH) domain and variable light (VL) domain described herein, including the sequence listing. In exemplary embodiments, the anti-PD-1 ABD includes a set of 6 CDRs with 1, 2, 3, 4, 5, 6, 7, 8, 9, 10 amino acid modifications as compared to the 6 CDRs of an anti-PD-1 antigen binding domain formed by any combination of an anti-PD-1 variable heavy (VH) domain and variable light (VL) domain described herein, wherein the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain is selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the anti-PD-1 ABD includes a set of 6 CDRs with 1, 2, 3, 4, 5, 6, 7, 8, 9, 10 amino acid modifications as compared to the 6 CDRs of an anti-PD-1 antigen binding domain formed by any combination of an anti-PD-1 variable heavy (VH) domain and variable light (VL) domain described herein, including any of following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479.

In one embodiment, the anti-PD-1 ABD includes 6 CDRs that are at least 90, 95, 97, 98 or 99% identical to the 6 CDRs of an anti-PD-1 antigen binding domain formed by any combination of an anti-PD-1 variable heavy (VH) domain and variable light (VL) domain described herein, including the sequence listing. In exemplary embodiments, the anti-PD-1 ABD includes 6 CDRs that are at least 90, 95, 97, 98 or 99% identical to the 6 CDRs of an anti-PD-1 antigen binding domain formed by a combination of an anti-PD-1 variable heavy (VH) domain and variable light (VL) domain described herein, wherein the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain is selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the anti-PD-1 ABD includes 6 CDRs that are at least 90, 95, 97, 98 or 99% identical to the 6 CDRs of an anti-PD-1 antigen binding domain formed by a combination of an anti-PD-1 variable heavy (VH) domain and variable light (VL) domain described herein, including any of following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479. In certain embodiments, the anti-PD-1 ABD is capable of binding to PD-1 antigen, as measured by at least one of a Biacore, surface plasmon resonance (SPR) and/or BLI (biolayer interferometry, e.g., Octet assay) assay, with the latter finding particular use in many embodiments. In particular embodiments, the anti-PD-1 ABD is capable of binding human PD-1.

In another exemplary embodiment, the anti-PD-1 ABD include the variable heavy (VH) domain and variable light (VL) domain of any one of the anti-PD-1 VH domains and VL domains described herein, including the sequence listing. In exemplary embodiments, the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain is selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the variable heavy domain and variable light domain is any of following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479.

In addition to the parental anti-PD-1 binding domain variable heavy and variable light domains disclosed herein, provided herein are anti-PD-1 ABDs that include a variable heavy domain and/or a variable light domain that are variants of an anti-PD-1 ABD variable heavy (VH) domain and variable light (VL) domain disclosed herein. In one embodiment, the variant VH domain and/or VL domain has from 1, 2, 3, 4, 5, 6, 7, 8, 9 or 10 amino acid changes from a VH and/or VL domain of an anti-PD-1 variable heavy (VH) domain and variable light (VL) domain described herein, including the sequence listing. In exemplary embodiments, the variant VH domain and/or VL domain has from 1, 2, 3, 4, 5, 6, 7, 8, 9 or 10 amino acid changes from a VH and/or VL domain, wherein the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the variant VH domain and/or VL domain has from 1, 2, 3, 4, 5, 6, 7, 8, 9 or 10 amino acid changes from a VH and/or VL domain selected from any of following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479. In certain embodiments, the anti-PD-1 ABD is capable of binding to PD-1, as measured by at least one of a Biacore, surface plasmon resonance (SPR) and/or BLI (biolayer interferometry, e.g., Octet assay) assay, with the latter finding particular use in many embodiments. In particular embodiments, the anti-PD-1 ABD is capable of binding human PD-1.

In one embodiment, the variant VH and/or VL domain is at least 90, 95, 97, 98 or 99% identical to the VH and/or VL of an anti-PD-1 ABD as described herein, including the sequence listing. In exemplary embodiments, the variant VH and/or VL domain is at least 90, 95, 97, 98 or 99% identical to a VH and/or VL, wherein the variable heavy domain is selected from the group consisting of: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, and SEQ ID NO:123, and the variable light domain selected from the group consisting of: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, and SEQ ID NO: 127. In exemplary embodiments, the variant VH and/or VL domain is at least 90, 95, 97, 98 or 99% identical to a VH and/or VL selected from any of following VH/VL combinations: SEQ ID NOs:131 and 135, SEQ ID NOs:139 and 143, SEQ ID NOs:147 and 151, SEQ ID NOs:155 and 159, SEQ ID NOs:163 and 167, SEQ ID NOs:171 and 175, SEQ ID NOs:179 and 183, SEQ ID NOs:187 and 191, SEQ ID NOs:195 and 199, SEQ ID NOs:203 and 207, SEQ ID NOs:211 and 215, SEQ ID NOs:219 and 223, SEQ ID NOs:227 and 231, SEQ ID NOs:235 and 239, SEQ ID NOs:243 and 247, SEQ ID NOs:251 and 255, SEQ ID NOs:259 and 264, SEQ ID NOs:267 and 271, SEQ ID NOs:275 and 279, SEQ ID NOs:283 and 287, SEQ ID NOs:291 and 295, SEQ ID NOs:299 and 303, SEQ ID NOs:307 and 211, SEQ ID NOs:315 and 319, SEQ ID NOs:323 and 327, SEQ ID NOs:331 and 335, SEQ ID NOs:339 and 343, SEQ ID NOs:347 and 351, SEQ ID NOs:355 and 359, SEQ ID NOs:363 and 367, SEQ ID NOs:371 and 375, SEQ ID NOs:379 and 384, SEQ ID NOs:387 and 391, SEQ ID NOs:395 and 399, SEQ ID NOs:403 and 407, SEQ ID NOs:411 and 415, SEQ ID NOs:419 and 423, SEQ ID NOs:427 and 431, SEQ ID NOs:435 and 439, SEQ ID NOs:443 and 447, SEQ ID NOs:451 and 455, SEQ ID NOs:459 and 463, SEQ ID NOs:467 and 471, and SEQ ID NOs:475 and 479. In certain embodiments, the anti-PD-1 ABD is capable of binding to PD-1, as measured by at least one of a Biacore, surface plasmon resonance (SPR) and/or BLI (biolayer interferometry, e.g., Octet assay) assay, with the latter finding particular use in many embodiments. In particular embodiments, the anti-PD-1 ABD is capable of binding human PD-1.

Such PD-1 binding domains can be included in any of the heterodimeric antibodies provided herein including, for example, the "1+1 Fab-scFv-Fc," "1+1 Fab-VHH-Fc," "1+1 VHH-scFv-Fc," "2+1 $Fab_2$-scFv-Fc," and "2+1 $Fab_2$-VHH-Fc" format antibodies disclosed herein.

H. Useful Formats of the Invention

As will be appreciated by those in the art and discussed more fully below, the bispecific heterodimeric antibodies of the present invention can take on a wide variety of configurations, as are generally depicted in FIGS. 14 and 15.

As will be appreciated by those in the art, the heterodimeric formats (see FIGS. 14 and 15) of the invention can have different valencies as well as be bispecific. That is, antibodies of the invention can be bivalent and bispecific, wherein the CD5 target is bound by one ABD and the TGFßRII is bound by a second ABD (see for example the 1+1 formats of FIG. 14 which are heterodimeric). The heterodimeric antibodies can also be trivalent and bispecific, wherein the first antigen is bound by two ABDs and the second antigen by a second ABD (see for example FIG. 15).

1. 1+1 Fab-scFv-Fc Format

One heterodimeric scaffold that finds particular use in the antibodies described herein is the "1+1 Fab-scFv-Fc" or "bottle-opener" format as shown in FIG. 14A that utilizes ABDs to two antigens (labeled "X" and "Y" to show interchangeability). In this embodiment, one heavy chain monomer of the antibody contains a single chain Fv ("scFv", as defined below) and an Fc domain. The scFv includes a variable heavy domain (VH1) and a variable light domain (VL1), wherein the VH1 is attached to the VL1 using an scFv linker that can be charged (see, e.g., FIG. 5). The scFv is attached to the heavy chain using a domain linker (see, e.g., FIG. 6). A scFv domain can be in either orientation from N- to C-terminus (VH-linker-VL or VL-linker-VH). Thus, in some embodiments, the VH1 is attached to the Fc domain and, in other embodiments, the VL1 of the scFv is attached to the Fc domain of the heavy chain. The other heavy chain monomer is a "regular" heavy chain (VH-CH1-hinge-CH2-CH3). The 1+1 Fab-scFv-Fc also includes a light chain that interacts with the VH-CH1 of the "regular" chain to form a Fab. This structure is sometimes referred to herein as the "bottle-opener" format, due to a rough visual similarity to a bottle-opener. The two heavy chain monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below.

There are several distinct advantages to the present "1+1 Fab-scFv-Fc" format. As is known in the art, antibody analogs relying on two scFv constructs often have stability and aggregation problems, which can be alleviated in the antibodies described herein by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the 1+1 Fab-scFv-Fc or "bottle opener" format antibody that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker The domain linker can be either charged or uncharged and exogenous or endogenous (e.g., all or part of the native hinge domain). Any suitable linker can be used to attach the scFv to the N-terminus of the first Fc domain. In some embodiments, the domain linker is chosen from the domain linkers in FIG. 6. The second monomer of the 1+1 Fab-scFv-Fc format or "bottle opener" format is a heavy chain, and the composition further comprises a light chain.

In FIG. 14A, as will be appreciated by those in the art, the Fab side can be bind CD5 and the scFv side can bind TGFßRII, or vice versa, e.g. where the Fab side binds TGFßRII and the scFv side binds CD5. In some embodiments, the Fab side binds PD-1 and the scFv side binds TGFßRII. In some embodiments, the Fab side binds TGFßRII and the scFv side binds PD-1.

In addition, the Fc domains of the antibodies described herein generally include skew variants (e.g. a set of amino acid substitutions as shown in FIGS. 1 and 4, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L; K370S:S364K/E357Q; T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In certain embodiments, the 1+1 Fab-scFv-Fc format includes a first monomer that includes, from N- to C-terminus, a scFv-domain linker-CH2-CH3 monomer, a second monomer that includes a first variable heavy domain-CH1-hinge-CH2-CH3 monomer and a third monomer that includes a first variable light domain and a constant light domain. In some embodiments, the CH2-CH3 of the first monomer is a first variant Fc domain and the CH2-CH3 of the second monomer is a second variant Fc domain. In some embodiments, the scFv includes a scFv variable heavy domain and a scFv variable light domain that form a binding moiety. In certain embodiments, the scFv variable heavy domain and scFv variable light domain are covalently attached using an scFv linker (charged, in many but not all instances. See, e.g., FIG. 5). A scFv domain can be in either orientation from N- to C-terminus (VH-linker-VL or VL-linker-VH). In some embodiments, the scFv is oriented from N- to C-terminus, scFv variable heavy domain-scFv linker-scFv variable light domain, and the scFv variable light domain is attached to the CH2-CH3 of the first monomer. In some embodiments, the scFv is oriented from N- to C-terminus, scFv variable light domain-scFv linker-scFv variable heavy domain, and the scFv variable heavy domain is attached to the CH2-CH3 of the first monomer.

In some embodiments, the 1+1 Fab-scFv-Fc format antibody includes any one of the anti-CD5 antigen binding domains provided herein. In exemplary embodiments, the 1+1 Fab-scFv-Fc format antibody includes a Fab side that includes any of the anti-CD5 antigen binding domains provided herein. In exemplary embodiments, the 1+1 Fab-scFv-Fc format antibody includes an scFv side that includes any of the anti-CD5 antigen binding domains provided herein. In some embodiments, the anti-CD5 antigen binding domain includes the 6 CDRs or the VH and VL of any of the anti-CD5 antigen binding domains described herein, including those depicted in FIGS. 61-63 and 88 and the sequence listing or a variant thereof.

In some embodiments, the 1+1 Fab-scFv-Fc format antibody includes any one of the anti-TGFßRII antigen binding domains provided herein. In some embodiments of the 1+1 Fab-scFv-Fc format antibody, the anti-TGFßRII includes the 6 CDRs or the VH and VL of any of the anti-TGFßRII antigen binding domains described herein, including those depicted in FIGS. 19, 87, 89 and the sequence listing or a variant thereof.

In some embodiments of the 1+1 Fab-scFv-Fc format antibody, the antibody is an anti-CD5×anti-TGFßRII bispecific antibody, wherein the Fab side is the anti-CD5 ABD and the scFv side is the anti-TGFßRII ABD. In some embodiments of the 1+1 Fab-scFv-Fc format antibody, the Fab side is the anti-TGFßRII ABD and the scFv side is the CD5 ABD.

In some embodiments of the anti-CD5×anti-TGFßRII 1+1 Fab-scFv-Fc format antibody, the anti-TGFßRII ABD has a variable heavy and a variable light domain selected from those described herein, including those depicted in FIGS. 19, 87, 89 and the sequence listing or a variant thereof. In some embodiments, the TGFßRII binding domain comprises a variable heavy domain selected from: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310 or a variant thereof, and a variable light domain selected from: SEQ ID NO:1867, SEQ ID NO:1879, SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319 or a variant thereof. In exemplary embodiments, the TGFßRII binding domain comprises a variable heavy domain selected from: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, or a variant thereof and a variable light domain selected from: SEQ ID NO:1867, SEQ ID NO:1879, and SEQ ID NOs:1606-1703 or a variant thereof. In exemplary embodiments, the TGFßRII binding domain comprises a variable heavy domain and a variable light domain selected from the group consisting of: SEQ ID NOs:2389 and 1867, and SEQ ID NOs:2393 and 1867, respectively.

In some embodiments of the anti-CD5×anti-TGFßRII 1+1 Fab-scFv-Fc format antibody, the anti-CD5 ABD has a variable heavy and a variable light domain selected from those described herein, including those depicted in FIGS. 61-63 and 88 and the sequence listing or a variant thereof. In some embodiments, the CD5 binding domain comprises a variable heavy domain selected from: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, or a variant thereof, and a variable light domain selected from: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141 or a variant thereof. In exemplary embodiments, the CD5 binding domain comprises a variable heavy domain selected from: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, or a variant thereof, and a variable light domain selected from: SEQ ID NO:2175, SEQ ID NO:2167, SEQ ID NO:2191, SEQ ID NOs:1755-1757, SEQ ID NO:2151 and SEQ ID NO:2159 or a variant thereof. In exemplary embodiments, the CD5 binding domain comprises a variable heavy domain of SEQ ID NO:2187 and a variable light domain of SEQ ID NO:2175.

In some embodiments of the 1+1 Fab-scFv-Fc format antibody, the antibody is an anti-PD-1×anti-TGFßRII bispecific antibody, wherein the Fab side is the anti-PD-1 ABD and the scFv side is the anti-TGFßRII ABD. In some embodiments of the 1+1 Fab-scFv-Fc format antibody, the Fab side is the anti-TGFßRII ABD and the scFv side is the anti-PD-1 ABD.

In some embodiments of the anti-PD-1×anti-TGFßRII 1+1 Fab-scFv-Fc format antibody, the TGFßRII binding domain comprises a variable heavy domain selected from: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, or a variant thereof and a variable light domain selected from: SEQ ID NO:1867, SEQ ID NO:1879, and SEQ ID NOs:1606-1703 or a variant thereof. In exemplary embodiments, the TGFßRII binding domain comprises a variable heavy domain and a variable light domain selected from the group consisting of: SEQ ID NOs:2389 and 1867, and SEQ ID NOs:2393 and 1867, respectively.

In some embodiments of the anti-PD-1×anti-TGFßRII 1+1 Fab-scFv-Fc format antibody, the anti-PD-1 ABD has a variable heavy and a variable light domain selected from those described herein, including those depicted in the sequence listing or a variant thereof. In some embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479 or a variant thereof. In exemplary embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521 or a variant thereof. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments, the 1+1 Fab-scFv-Fc format includes skew variants, pI variants, and ablation variants. Accordingly, some embodiments include 1+1 Fab-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and an scFv; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering.

In some embodiments, the 1+1 Fab-scFv-Fc format includes skew variants, pI variants, ablation variants and FcRn variants. Accordingly, some embodiments include 1+1 Fab-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, the FcRn variants M428L/N434S and an scFv; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering.

FIG. 7 shows some exemplary Fc domain sequences that are useful in the 1+1 Fab-scFv-Fc format antibodies. The "monomer 1" sequences depicted in FIG. 7 typically refer to the Fc domain of the "Fab-Fc heavy chain" and the "monomer 2" sequences refer to the Fc domain of the "scFv-Fc heavy chain." Further, FIG. 12 provides useful CL sequences that can be used with this format.

Exemplary anti-TGFßRII×anti-PD-1 bsAbs in the 1+1 Fab-scFv-Fc format are depicted in FIG. 24.

Exemplary anti-TGFßRII×anti-CD5 bsAbs in the 1+1 Fab-scFv-Fc format are depicted in FIG. 64.

2. 1+1 Fab-VHH-Fc Format

In addition to the FIG. 14A format, another useful heterodimeric scaffold that finds particular use in the antibodies described herein is the "1+1 Fab-VHH-Fc" depicted in FIG. 14B, that utilizes ABDs to two antigens (labeled "X" and "Y" to show interchangeability; however, in this case, it is generally the TGFßRII ABD that is the VHH). In this embodiment, one heavy chain monomer of the antibody contains the VHH and an Fc domain. In some embodiments, the VHH can be attached to the N-terminus of the Fc by a domain linker (e.g., FIG. 6). The other heavy chain monomer is a "regular" heavy chain (VH-CH1-hinge-CH2-CH3). The 1+1 Fab-VHH-Fc also includes a light chain that interacts with the VH-CH1 of the "regular" chain to form a Fab. In some embodiments, the Fab binds the CD5 antigen. In some embodiments, the Fab binds the PD-1 antigen.

In some embodiments, the 1+1 Fab-VHH-Fc format antibody is an anti-CD5×anti-TGFßRII antibody. In FIG. 14B, as will be appreciated by those in the art, the Fab side can bind TGFßRII and the VHH side can bind CD5, or vice versa, e.g. where the Fab side binds CD5 and the VHH side binds TGFßRII. In some embodiments, the 1+1 Fab-VHH-Fc format antibody is an anti-PD-1×anti-TGFßRII antibody. In such embodiments, the Fab side can bind TGFßRII and the VHH side can bind PD-1, or vice versa, e.g. where the Fab side binds PD-1 and the VHH side binds TGFßRII.

In addition, the Fc domains of the antibodies described herein generally include skew variants (e.g. a set of amino acid substitutions as shown in FIGS. 1 and 4, with particularly useful skew variants being selected from the group consisting of S364K/E357Q:L368D/K370S; L368D/K370S: S364K; L368E/K370S:S364K; T411T/E360E/Q362E: D401K; L368D/K370S:S364K/E357L; K370S:S364K/E357Q; T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the 1+1 Fab-VHH-Fc format antibody includes any one of the anti-CD5 antigen binding domains provided herein. In exemplary embodiments, the 1+1 Fab-VHH-Fc format antibody includes a Fab side that includes any of the anti-CD5 antigen binding domains provided herein. In some embodiments, the anti-CD5 antigen binding domain includes the 6 CDRs or the VH and VL of any of the anti-CD5 antigen binding domains depicted in FIGS. 61-63 and 88 and the sequence listing or a variant thereof. In some embodiments, the CD5 binding domain comprises a variable heavy domain selected from: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, or a variant thereof, and a variable light domain selected from: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141 or a variant thereof. In exemplary embodiments, the CD5 binding domain comprises a variable heavy domain selected from: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, or a variant thereof, and a variable light domain selected from: SEQ ID NO:2175, SEQ ID NO:2167, SEQ ID NO:2191, SEQ ID NOs:1755-1757, SEQ ID NO:2151 and SEQ ID NO:2159 or a variant thereof. In exemplary embodiments, the CD5 binding domain comprises a variable heavy domain of SEQ ID NO:2187 and a variable light domain of SEQ ID NO:2175.

In some embodiments, the 1+1 Fab-VHH-Fc format antibody includes any one of the anti-PD-1 antigen binding domains provided herein. In exemplary embodiments, the 1+1 Fab-VHH-Fc format antibody includes a Fab side that includes any of the anti-PD-1 antigen binding domains provided herein. In some embodiments, the anti-PD-1 antigen binding domain includes the 6 CDRs or the VH and VL of any of the anti-PD-1 antigen binding domains depicted in the sequence listing or a variant thereof. In some embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, ora variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479 or a variant thereof. In exemplary embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521 or a variant thereof. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments of the 1+1 Fab-VHH-Fc format antibody is an anti-CD5×anti-TGFßRII bispecific antibody, wherein the Fab side is the anti-CD5 ABD and the VHH side is the TGFßRII ABD. In some embodiments of the 1+1 Fab-VHH-Fc format antibody is an anti-PD-1×anti-TGFßRII bispecific antibody, wherein the Fab side is the anti-PD-1 ABD and the VHH side is the TGFßRII ABD.

In some embodiments of the 1+1 Fab-VHH-Fc format antibody, the anti-TGFßRII ABD is the VHH and has any of the following sequences: SEQ ID NO: 580, 584, 588, 592, 596, 600, 604, 608, 612, 616, 620, 624, 628, 632, 636, 640, 644, 648, 652, 656, 660, 664, 668, 672, 676, 680, 684, 688, 692, 696, 700, 704, 708, 712, 716, 720, 724, 728, 732, 736, 740, 744, 748, 752, 756, 760, 764, 768, 772, 776, 780, 784, 788, 792, 796, 800, 804, 808, 812, 816, 820, 824, 828, 832, 836, 840, 844, 848, 852, 856, 860, 864, 868, 872, 876, 880, 884, 888, 892, 896, 900, 904, 908, 912, 916, 920, 924, 928, 932, and 936 or a variant thereof. In certain embodiments, the TGFßRII ABD is the VHH and has any of the following sequences: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605 or a variant thereof.

In some embodiments, the 1+1 Fab-VHH-Fc format includes skew variants, pI variants, and ablation variants. Accordingly, some embodiments include 1+1 Fab-VHH-Fc formats that comprise: a) a first monomer that comprises a charged scFv linker (with the +H sequence of FIG. 5 being preferred in some embodiments), the skew variants S364K/E357Q, the ablation variants E233P/L234V/L235A/G236del/S267K, and an scFv that binds to CD3 as outlined herein; b) a second monomer that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering.

In some embodiments, the 1+1 Fab-VHH-Fc format includes skew variants, pI variants, ablation variants and FcRn variants. Accordingly, some embodiments include 1+1 Fab-VHH-Fc formats that comprise: a) a first monomer (the "VHH monomer") that comprises the skew variants S364K/E357Q, the ablation variants E233P/L234V/L235A/G236del/S267K, the FcRn variants M428L/N434S and a VHH as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering.

Exemplary anti-TGFßRII×anti-PD-1 bsAbs in the 1+1 Fab-VHH-Fc format are depicted in FIG. 25.

Exemplary anti-TGFßRII×anti-CD5 bsAbs in the 1+1 Fab-VHH-Fc format are depicted in FIG. 65.

3. 1+1 VHH-scFv Fc Format

In addition to the FIGS. 14A and 14B formats, another useful heterodimeric scaffold that finds particular use in the antibodies described herein is the "1+1 VHH-scFv-Fc" depicted in FIG. 14C, that utilizes ABDs to two antigens (labeled "X" and "Y" to show interchangeability; however, in this case, it is generally the anti-TGFßRII ABD that is the VHH). In this embodiment, one heavy chain monomer of the antibody contains the VHH and an Fc domain. In this embodiment, the other monomer of the antibody contains a single chain Fv ("scFv", as defined below) and an Fc domain. The scFv includes a variable heavy domain (VH1) and a variable light domain (VL1), wherein the VH1 is attached to the VL1 using an scFv linker that can be charged (see, e.g., FIG. 5). The scFv is attached to the Fc domain using a domain linker (see, e.g., FIG. 6). In some embodiments, the scFv binds the CD5 antigen. In some embodiments, the scFv binds PD-1.

In some embodiments, the 1+1 VHH-scFv-Fc format antibody is an anti-CD5×anti-TGFßRII antibody. In FIG. 14C, as will be appreciated by those in the art, the scFv side can bind TGFßRII and the VHH side can bind CD5, or vice versa, e.g. where the scFv side binds CD5 and the VHH side binds TGFßRII. In some embodiments, the 1+1 VHH-scFv-Fc format antibody is an anti-PD-1×anti-TGFßRII antibody. In such embodiments, the scFv side can bind TGFßRII and the VHH side can bind PD-1, or vice versa, e.g. where the scFv side binds PD-1 and the VHH side binds TGFßRII.

In addition, the Fc domains of the antibodies described herein generally include skew variants (e.g. a set of amino acid substitutions as shown in FIGS. 1 and 4, with particularly useful skew variants being selected from the group consisting of S364K/E357Q:L368D/K370S; L368D/K370S:S364K; L368E/K370S:S364K; T411T/E360E/Q362E:D401K; L368D/K370S:S364K/E357L; K370S:S364K/E357Q; T366S/L368A/Y407V:T366W and T366S/L368A/Y407V/Y349C:T366W/S354C), optionally ablation variants (including those shown in FIG. 3), optionally charged scFv linkers (including those shown in FIG. 5) and the heavy chain comprises pI variants (including those shown in FIG. 2).

In some embodiments, the 1+1 VHH-scFv-Fc format antibody includes any one of the anti-CD5 antigen binding domains provided herein. In exemplary embodiments, the 1+1 VHH-scFv-Fc antibody includes an anti-CD5 scFv that includes the 6 CDRs or the VH and VL of any of the anti-CD5 antigen binding domains depicted in FIGS. 61-63 and 88 and the sequence listing or a variant thereof. In some embodiments, the CD5 binding domain comprises a variable heavy domain selected from: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, or a variant thereof, and a variable light domain selected from: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141 or a variant thereof. In exemplary embodiments, the CD5 binding domain comprises a variable heavy domain selected from: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, or a variant thereof, and a variable light domain selected from: SEQ ID NO:2175, SEQ ID NO:2167, SEQ ID NO:2191, SEQ ID NOs:1755-1757, SEQ ID NO:2151 and SEQ ID NO:2159 or a variant thereof. In exemplary embodiments, the CD5 binding domain comprises a variable heavy domain of SEQ ID NO:2187 and a variable light domain of SEQ ID NO:2175.

In some embodiments, the 1+1 VHH-scFv-Fc format antibody includes any one of the anti-PD-1 antigen binding domains provided herein. In exemplary embodiments, the 1+1 VHH-scFv-Fc format antibody includes a scFv side that includes any of the anti-PD-1 antigen binding domains provided herein. In some embodiments, the anti-PD-1 antigen binding domain includes the 6 CDRs or the VH and VL of any of the anti-PD-1 antigen binding domains depicted in the sequence listing or a variant thereof. In some embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479 or a variant thereof. In exemplary embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521 or a variant thereof. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments of the 1+1 scFv-VHH-Fc format antibody is an anti-CD5×anti-TGFßRII bispecific antibody, wherein the scFv side is the anti-CD5 ABD and the VHH side is the TGFßRII ABD. In some embodiments of the 1+1 Fab-VHH-Fc format antibody is an anti-PD-1×anti-TGFßRII bispecific antibody, wherein the scFv side is the anti-PD-1 ABD and the VHH side is the TGFßRII ABD.

In some embodiments of the 1+1 scFv-VHH-Fc format antibody, the anti-TGFßRII ABD is the VHH and has any of the following sequences: SEQ ID NO: 580, 584, 588, 592, 596, 600, 604, 608, 612, 616, 620, 624, 628, 632, 636, 640, 644, 648, 652, 656, 660, 664, 668, 672, 676, 680, 684, 688, 692, 696, 700, 704, 708, 712, 716, 720, 724, 728, 732, 736, 740, 744, 748, 752, 756, 760, 764, 768, 772, 776, 780, 784, 788, 792, 796, 800, 804, 808, 812, 816, 820, 824, 828, 832, 836, 840, 844, 848, 852, 856, 860, 864, 868, 872, 876, 880, 884, 888, 892, 896, 900, 904, 908, 912, 916, 920, 924, 928, 932, and 936 or a variant thereof. In certain embodiments, the TGFßRII ABD is the VHH and has any of the following sequences: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605 or a variant thereof.

In some embodiments, the 1+1 VHH-scFv-Fc format antibody includes skew variants, pI variants, and ablation variants. Accordingly, some embodiments include 1+1 VHH-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and an scFv as outlined herein; b) a second monomer that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering.

In some embodiments, the 1+1 VHH-scFv-Fc format antibody includes skew variants, pI variants, ablation variants and FcRn variants. Accordingly, some embodiments include 1+1 VHH-scFv-Fc formats that comprise: a) a first monomer that comprises a charged scFv linker (with the +H sequence of FIG. 6 being preferred in some embodiments), the skew variants S364K/E357Q, the ablation variants E233P/L234V/L235A/G236del/S267K, the FcRn variants M428L/N434S; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering.

Exemplary anti-TGFßRII×anti-PD-1 bsAbs in the 1+1 Fab-VHH-Fc format are depicted in FIG. 26.

Exemplary anti-TGFßRII×anti-CD5 bsAbs in the 1+1 scFv-VHH-Fc format are depicted in FIG. 66.

In addition to antibodies that are bivalent and bispecific, the present invention also provides formats that include trivalent bispecific constructs, wherein the antibodies bind one antigen (either TGFßRII or CD5) bivalently (e.g. contain two ABDs) and the other antigen monovalently (with one ABD), such as are generally depicted in FIG. 15.

4. 2+1 $Fab_2$-scFv-Fc Format

One heterodimeric scaffold that finds particular use in the present invention is the 2+1 $Fab_2$-scFv-Fc format shown in FIG. 15A. In this embodiment, the format relies on the use of an inserted scFv domain thus forming a third antigen binding domain, wherein the Fab portions of the two monomers bind one checkpoint target and the "extra" scFv domain binds another. The scFv domain is inserted between the Fc domain and the CH1-Fv region of one of the monomers, thus providing a third antigen binding domain.

In this embodiment, one monomer comprises a first monomer comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (VH1-CH1-[optional linker]-VH2-scFv linker-VL2-[optional linker including the hinge]-CH2-CH3, or the opposite orientation for the scFv, VH1-CH1-[optional linker]-VL2-scFv linker-VH2-[optional linker including the hinge]-CH2-CH3). The other monomer (the second monomer) is a standard Fab side (i.e., a VH1-CH1-hinge-CH2-CH3 monomer). This embodiment further utilizes a common light chain comprising a variable light domain and a constant light domain that associates with the VH1 variable heavy domains of the two monomers to form two identical Fabs that bind a checkpoint inhibitor. As for many of the embodiments herein, these constructs include skew variants, pI variants, ablation variants, additional Fc variants, etc. as desired and described herein.

In some embodiments, the 2+1 $Fab_2$-scFv-Fc format antibody includes any one of the anti-CD5 antigen binding domains provided herein. In exemplary embodiments, the 2+1 $Fab_2$-scFv-Fc format antibody includes two Fabs that includes the 6 CDRs or the VH and VL of any of the anti-CD5 antigen binding domains depicted in FIGS. 61-63 and 88 or a variant thereof. In some embodiments, the CD5 binding domain comprises a variable heavy domain selected from: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, or a variant thereof, and a variable light domain selected from: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141 or a variant thereof. In exemplary embodiments, the CD5 binding domain comprises a variable heavy domain selected from: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, or a variant thereof, and a variable light domain selected from: SEQ ID NO:2175, SEQ ID NO:2167, SEQ ID NO:2191, SEQ ID NOs:1755-1757, SEQ ID NO:2151 and SEQ ID NO:2159 or a variant thereof. In exemplary embodiments, the CD5 binding domain comprises a variable heavy domain of SEQ ID NO:2187 and a variable light domain of SEQ ID NO:2175.

In some embodiments of the 2+1 $Fab_2$-scFv-Fc format antibody, each of the Fabs are anti-CD5 ABD and the scFv is the anti-TGFßRII ABD. In some embodiments of the 2+1 $Fab_2$-scFv-Fc format antibody, the two Fab sides are anti-TGFßRII ABDs and the scFv is the anti-CD5 ABD.

In some embodiments of the 2+1 $Fab_2$-scFv-Fc format antibody, the anti-TGFßRII ABD has variable heavy and variable light domains selected from those depicted in in FIGS. 19, 87, 89 and the sequence listing or a variant thereof. In some embodiments, the anti-TGFßRII ABD has a variable heavy and a variable light domain selected from those described herein, including those depicted in FIGS. 19, 87, 89 and the sequence listing or a variant thereof. In some embodiments, the TGFßRII binding domain comprises a variable heavy domain selected from: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605, SEQ ID NO:525, SEQ ID NO:533, SEQ ID NO:541, SEQ ID NO:549, SEQ ID NO:557, SEQ ID NO:562, SEQ ID NO:564, SEQ ID NO:572, SEQ ID NO:990, SEQ ID NO:994, SEQ ID NO:998, SEQ ID NO:1002, SEQ ID NO:1006, SEQ ID NO:1010, SEQ ID NO:1014, SEQ ID NO:1018, SEQ ID NO:1022, SEQ ID NO: 1026, SEQ ID NO: 1030, SEQ ID NO:1034, SEQ ID NO:1038, SEQ ID NO:1042, SEQ ID NO:1046, SEQ ID NO:1050, SEQ ID NO:1054, SEQ ID NO:1058, SEQ ID NO:1062, SEQ ID NO:1066, SEQ ID NO:1070, SEQ ID NO:1074, SEQ ID NO: 1078, SEQ ID NO: 1082, SEQ ID NO:1086, SEQ ID NO:1090, SEQ ID NO:1094, SEQ ID NO:1098, NO:1102, SEQ ID NO:1106, SEQ ID NO:1110, SEQ ID NO:1114, SEQ ID NO:1118, SEQ ID NO:1122, SEQ ID NO: 1126, SEQ ID NO: 1130, SEQ ID NO:1134, SEQ ID NO:1138, SEQ ID NO:1142, SEQ ID NO:1146, SEQ ID NO:1150, SEQ ID NO:1154, SEQ ID NO:1158, SEQ ID NO:1162, SEQ ID NO:1166, SEQ ID NO:1170, SEQ ID NO:1174, SEQ ID NO: 1178, SEQ ID NO: 1182, SEQ ID NO:1186, SEQ ID NO:1190, SEQ ID NO:1194, SEQ ID NO:1198, NO:1202, SEQ ID NO:1206, SEQ ID NO:1210, SEQ ID NO:1214, SEQ ID NO:1218, SEQ ID NO:1222, SEQ ID NO: 1226, SEQ ID NO: 1230, SEQ ID NO:1234, SEQ ID NO:1238, SEQ ID NO:1242, SEQ ID NO:1246, SEQ ID NO:1250, SEQ ID NO:1254, SEQ ID NO:1258, SEQ ID NO:1262, SEQ ID NO:1266, SEQ ID NO:1270, SEQ ID NO:1274, SEQ ID NO: 1278, SEQ ID NO: 1282, SEQ ID NO:1286, SEQ ID NO:1290, SEQ ID NO:1294, SEQ ID NO:1298, SEQ ID NO:1302, SEQ ID NO:1306, and SEQ ID NO:1310 or a variant thereof, and a variable light domain selected from: SEQ ID NO:1867, SEQ ID NO:1879, SEQ ID NOs:1606-1703, SEQ ID NO:529, SEQ ID NO:537, SEQ ID NO:545, SEQ ID NO:553, SEQ ID NO:561, SEQ ID NO:563, SEQ ID NO:568, SEQ ID NO:576, SEQ ID NO:1314, SEQ ID NO:1315, and SEQ ID NO:1319 or a variant thereof. In exemplary embodiments, the TGFßRII binding domain comprises a variable heavy domain selected from: SEQ ID NOs: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, 1859, 1863, 1871, 1875, and 1323-1605, or a variant thereof and a variable light domain selected from: SEQ ID NO:1867, SEQ ID NO:1879, SEQ ID NOs:1606-1703 or a variant thereof. In exemplary embodiments, the TGFßRII binding domain comprises a variable heavy domain and a variable light domain selected from the group consisting of: SEQ ID NOs:2389 and 1867, and SEQ ID NOs:2393 and 1867, respectively.

In some embodiments of the 2+1 $Fab_2$-scFv-Fc format antibody, each of the Fabs are anti-PD-1 and the scFv is the anti-TGFßRII ABD. In some embodiments of the 2+1 $Fab_2$-scFv-Fc format antibody, the two Fab sides are anti-TGFßRII ABDs and the scFv is the anti-PD-1 ABD.

In some embodiments, the 2+1 $Fab_2$-scFv-Fc format antibody includes any one of the anti-PD-1 antigen binding domains provided herein. In exemplary embodiments, the 2+1 $Fab_2$-scFv-Fc format antibody includes a Fab side that includes any of the anti-PD-1 antigen binding domains provided herein. In some embodiments, the anti-PD-1 antigen binding domain includes the 6 CDRs or the VH and VL of any of the anti-PD-1 antigen binding domains depicted in the sequence listing or a variant thereof. In some embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479 or a variant thereof. In exemplary embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521 or a variant thereof. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments, the 2+1 $Fab_2$-scFv-Fc format includes skew variants, pI variants, and ablation variants. Accordingly, some embodiments include 2+1 $Fab_2$-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering.

In some embodiments, the 2+1 $Fab_2$-scFv-Fc format includes skew variants, pI variants, ablation variants and FcRn variants. Accordingly, some embodiments include 2+1 $Fab_2$-scFv-Fc formats that comprise: a) a first monomer (the "scFv monomer") that comprises a charged scFv linker (with the +H sequence of FIG. 6 being preferred in some embodiments), the skew variants S364K/E357Q, the ablation variants E233P/L234V/L235A/G236del/S267K, the FcRn variants M428L/N434S and an scFv as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering.

FIG. 7 shows some exemplary Fc domain sequences that are useful with the 2+1 $Fab_2$-scFv-Fc format. The "monomer 1" sequences depicted in FIG. 7 typically refer to the Fc domain of the "Fab-Fc heavy chain" and the "monomer 2" sequences refer to the Fc domain of the other heavy chain. In addition, FIGS. 8-11 provides exemplary CH1-hinge domains, CH1 domains, and hinge domains that can be included in the first or second monomer of the 2+1 $Fab_2$-scFv-Fc format. Further, FIG. 12 provides useful CL sequences that can be used with this format.

5. 2+1 $Fab_2$-VHH-Fc Format

An additional heterodimeric scaffold that finds particular use in the present invention is the 2+1 $Fab_2$-VHH-Fc format shown in FIG. 15B. In this embodiment, the format relies on the use of an inserted VHH domain thus forming a third antigen binding domain, wherein the Fab portions of the two monomers bind one target and the "extra" VHH domain binds another. The VHH domain is inserted between the Fc domain and the CH1-Fv region of one of the monomers, thus providing a third antigen binding domain.

In this embodiment, one monomer comprises a first heavy chain comprising a first variable heavy domain, a CH1 domain (and optional hinge) and Fc domain, with a VHH domain. The VHH is covalently attached between the C-terminus of the CH1 domain of the heavy constant domain and the N-terminus of the first Fc domain using optional domain linkers (vh1-CH1-[optional linker]-VHH-[optional linker including the hinge]-CH2-CH3. The other monomer is a standard Fab side. This embodiment further utilizes a common light chain comprising a variable light domain and a constant light domain, which associates with the heavy chains to form two identical Fabs that bind a target. As for many of the embodiments herein, these constructs include skew variants, pI variants, ablation variants, additional Fc variants, etc. as desired and described herein.

In some embodiments, the 2+1 $Fab_2$-VHH-Fc format antibody includes any one of the anti-CD5 antigen binding domains provided herein. In exemplary embodiments, the 2+1 $Fab_2$-VHH-Fc format antibody includes two Fabs that includes the 6 CDRs or the VH and VL of any of the anti-CD5 antigen binding domains depicted in FIGS. 61-63 and 88 or a variant thereof. In some embodiments, the CD5 binding domain comprises a variable heavy domain selected from: SEQ ID NO:2187, SEQ ID NO:2147, SEQ ID NO:2155, VH: SEQ ID NO:2163, SEQ ID NO:2171, SEQ ID NO:2179, SEQ ID NO:2183, SEQ ID NO:s1704-1754, SEQ ID NO:1, SEQ ID NO:9, SEQ ID NO:17, SEQ ID NO:25, SEQ ID NO:33, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:59, SEQ ID NO:61, SEQ ID NO:63, SEQ ID NO:65, SEQ ID NO:67, SEQ ID NO:69, SEQ ID NO:71, SEQ ID NO:73, SEQ ID NO:75, SEQ ID NO:77, SEQ ID NO:79, SEQ ID NO:81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, and SEQ ID NO:2137, or a variant thereof, and a variable light domain selected from: SEQ ID NO:2175, SEQ ID NO:2151, SEQ ID NO:2159, SEQ ID NO:2167, SEQ ID NO:2191, SEQ ID NOs:1755-1757, SEQ ID NO:5, SEQ ID NO:13, SEQ ID NO:21, SEQ ID NO:29, SEQ ID NO:37, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, and SEQ ID NO:2141 or a variant thereof. In exemplary embodiments, the CD5 binding domain comprises a variable heavy domain selected from: SEQ ID NO:2187, SEQ ID NO:2163, SEQ ID NO:2171, SEQ ID NO:2179, SEQ ID NO:2183, SEQ ID NO:s1704-1754, SEQ ID NO:2147 and SEQ ID NO:2155, or a variant thereof, and a variable light domain selected from: SEQ ID NO:2175, SEQ ID NO:2167, SEQ ID NO:2191, SEQ ID NOs:1755-1757, SEQ ID NO:2151 and SEQ ID NO:2159 or a variant thereof. In exemplary embodiments, the CD5 binding domain comprises a variable heavy domain of SEQ ID NO:2187 and a variable light domain of SEQ ID NO:2175.

In some embodiments of the 2+1 $Fab_2$-VHH-Fc format antibody, the two Fabs are the anti-CD5 ABDs and the VHH side is the anti-TGFßRII ABD.

In some embodiments of the 2+1 $Fab_2$-VHH-Fc format antibody, the anti-TGFßRII VHH ABD has the VHH and has any of the following sequences: SEQ ID NO: 580, 584, 588, 592, 596, 600, 604, 608, 612, 616, 620, 624, 628, 632, 636, 640, 644, 648, 652, 656, 660, 664, 668, 672, 676, 680, 684, 688, 692, 696, 700, 704, 708, 712, 716, 720, 724, 728, 732, 736, 740, 744, 748, 752, 756, 760, 764, 768, 772, 776, 780, 784, 788, 792, 796, 800, 804, 808, 812, 816, 820, 824, 828, 832, 836, 840, 844, 848, 852, 856, 860, 864, 868, 872, 876, 880, 884, 888, 892, 896, 900, 904, 908, 912, 916, 920, 924, 928, 932, and 936 or a variant thereof. In certain embodiments, the TGFßRII ABD is the VHH and has any of the following sequences: SEQ ID NO:2389, SEQ ID NO:2393, SEQ ID NO:2369, SEQ ID NO:2373, SEQ ID NO:2377, SEQ ID NO:2381, SEQ ID NO:2385, SEQ ID NO:2397, SEQ ID NO:1859, SEQ ID NO:1863, SEQ ID NO:1871, SEQ ID NO:1875, SEQ ID NOs:1323-1605 or a variant thereof.

In some embodiments of the 2+1 $Fab_2$-VHH-Fc format antibody, the two Fabs are the anti-PD-1 ABDs and the VHH side is the anti-TGFßRII ABD.

In some embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, SEQ ID NO:115, SEQ ID NO:123, SEQ ID NO:131, SEQ ID NO:139, SEQ ID NO:147, SEQ ID NO:155, SEQ ID NO:163, SEQ ID NO:171, SEQ ID NO:179, SEQ ID NO:187, SEQ ID NO:195, SEQ ID NO:203, SEQ ID NO:211, SEQ ID NO:219, SEQ ID NO:227, SEQ ID NO:235, SEQ ID NO:243, SEQ ID NO:251, SEQ ID NO:259, SEQ ID NO:267, SEQ ID NO:275, SEQ ID NO:283, SEQ ID NO:291, SEQ ID NO:299, SEQ ID NO:307, SEQ ID NO:315, SEQ ID NO:323, SEQ ID NO:331, SEQ ID NO:339, SEQ ID NO:347, SEQ ID NO:355, SEQ ID NO:363, SEQ ID NO:371, SEQ ID NO:379, SEQ ID NO:387, SEQ ID NO:395, SEQ ID NO:403, SEQ ID NO:411, SEQ ID NO:419, SEQ ID NO:427, SEQ ID NO:435, SEQ ID NO:443, SEQ ID NO:451, SEQ ID NO:459, SEQ ID NO:467, and SEQ ID NO:475, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, SEQ ID NO:521, SEQ ID NO:119, SEQ ID NO: 127, SEQ ID NO:135, SEQ ID NO:143, SEQ ID NO:151, SEQ ID NO:159, SEQ ID NO:167, SEQ ID NO:175, SEQ ID NO:183, SEQ ID NO:191, SEQ ID NO:198, SEQ ID NO:207, SEQ ID NO:215, SEQ ID NO:223, SEQ ID NO:231, SEQ ID NO:239, SEQ ID NO:247, SEQ ID NO:255, SEQ ID NO:263, SEQ ID NO:271, SEQ ID NO:279, SEQ ID NO:287, SEQ ID NO:295, SEQ ID NO:303, SEQ ID NO:311, SEQ ID NO:319, SEQ ID NO:327, SEQ ID NO:335, SEQ ID NO:343, SEQ ID NO:351, SEQ ID NO:359, SEQ ID NO:367, SEQ ID NO:375, SEQ ID NO:383, SEQ ID NO:391, SEQ ID NO:399, SEQ ID NO:407, SEQ ID NO:415, SEQ ID NO:423, SEQ ID NO:431, SEQ ID NO:439, SEQ ID NO:447, SEQ ID NO:455, SEQ ID NO:463, SEQ ID NO:471, and SEQ ID NO:479 or a variant thereof. In exemplary embodiments, the PD-1 binding domain comprises a variable heavy domain selected from: SEQ ID NO:483, SEQ ID NO:959, SEQ ID NO:487, SEQ ID NO:491, SEQ ID NO:495, SEQ ID NO:499, SEQ ID NO:503, SEQ ID NO:943, SEQ ID NO:947, SEQ ID NO:951, SEQ ID NO:955, SEQ ID NO:963, SEQ ID NO:967, and SEQ ID NO:971, or a variant thereof, and a variable light domain selected from: SEQ ID NO:979, SEQ ID NO:517, SEQ ID NO:975, SEQ ID NO:983, SEQ ID NO:987, SEQ ID NO:501, SEQ ID NO:505, SEQ ID NO:509, SEQ ID NO:513, and SEQ ID NO:521 or a variant thereof. In exemplary embodiments, the PD-1 binding domain comprises a variable heavy domain and a variable light domain selected from the group consisting of: SEQ ID NOs:483 and 979, and SEQ ID NOs:959 and 517, respectively.

In some embodiments, the 2+1 $Fab_2$-VHH-Fc format includes skew variants, pI variants, and ablation variants. Accordingly, some embodiments include 1+1 Fab-VHH-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and a VHH as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain (VL) and a constant light domain (CL), wherein numbering is according to EU numbering.

In some embodiments, the 2+1 $Fab_2$-VHH-Fc format includes skew variants, pI variants, ablation variants and FcRn variants. Accordingly, some embodiments include 2+1 $Fab_2$-VHH-Fc formats that comprise: a) a first monomer (the "VHH monomer") that comprises the skew variants S364K/E357Q, the ablation variants E233P/L234V/L235A/G236del/S267K, the FcRn variants M428L/N434S and an scFv as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering.

FIG. 7 shows some exemplary Fc domain sequences that are useful with the 2+1 $Fab_2$-VHH-Fc format. The "monomer 1" sequences depicted in FIG. 7 typically refer to the Fc domain of the "Fab-Fc heavy chain" and the "monomer 2" sequences refer to the Fc domain of the other heavy chain. In addition, FIGS. 8-11 provides exemplary CH1-hinge domains, CH1 domains, and hinge domains that can be included in the first or second monomer of the 2+1 $Fab_2$-VHH-Fc format. Further, FIG. 12 provides useful CL sequences that can be used with this format.

6. Monospecific, Monoclonal Antibodies

As will be appreciated by those in the art, the novel Fv sequences outlined herein for anti-CD5, anti-TGFßRII and anti-PD-1 ABDs can also be used in both monospecific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

I. Nucleic Acids of the Invention

The invention further provides nucleic acid compositions encoding the bispecific antibodies of the invention (or, in the case of "monospecific" antibodies, nucleic acids encoding those as well).

As will be appreciated by those in the art, the nucleic acid compositions will depend on the format and scaffold of the heterodimeric protein. Thus, for example, when the format requires three amino acid sequences, such as for FIGS. 14A and 14B, three nucleic acid sequences can be incorporated into one or more expression vectors for expression. Similarly, some formats (e.g., FIG. 14C) only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

J. Antibody Compositions for In Vivo Administration

Formulations of the antibodies and compositions provided herein are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions.

K. Treatments

Once made, the compositions of the invention find use in a number of oncology applications, by treating cancer, generally by inhibiting the suppression of T cell activation (e.g., T cells are no longer suppressed) with the binding of the subject antibodies described herein.

Accordingly, the heterodimeric compositions of the invention find use in the treatment of these cancers.

L. Combination Therapies

In some embodiments, the bispecific antibody can be co-administered with a separate anti-PD-1 antibody such as pembrolizumab (Keytruda®) or nivolumab (Opdivo®). Co-administration can be done simultaneously or sequentially, as will be appreciated by those in the art.

II. EXAMPLES

A. Example 1: TGFß is Immunosuppressive

As described above, tumors can evade immune surveillance by producing the immunosuppressive cytokine TGFß. Accordingly, in vitro assays were established to probe these immunosuppressive effects and eventually to test the molecules of the invention.

1. TGFß Induces Phosphorylation of SMAD2/3 in T Cells In Vitro

TGFß binds to the TGFßRII receptor which subsequently recruits, phosphorylates and activates TGFßRI. TGFßRI in turn phosphorylates SMAD2/3 which then associates with SMAD4. The SMAD2/3:SMAD4 heterocomplex translocate into the nucleus to regulate further downstream processes. Phosphorylation of SMAD2/3 as an indicator of TGFß1 biological activity was demonstrated in vitro as follows. Human PBMC was seeded on 0.5 μg/ml anti-CD3 for 48 hours for activation, then serum deprived for 16 hours in 0.1% FBS (to remove confounding effect of TGFß in serum). The PBMC was then incubated with indicated dose of TGFß1 for 30 minutes at 37° C. Following incubation, intracellular phospho-flow cytometry was performed to measure phosphorylated SMAD2/3 (pSMAD2/3). The data as depicted in FIG. 16 show that TGFß1 dose dependently induces phosphorylation of SMAD2/3 on CD4+ and CD8+ T cells, and limited phosphorylation of SMAD2/3 on B cells and NK cells.

2. TGFß Suppresses T Cell Proliferation, IFNγ Secretion, and CD95 Expression Induced by Nivolumab The suppressive effects of TGFß was modeled in vitro in a mixed lymphocyte reaction (MLR). In an MLR, allogeneic (different MHC haplotype) lymphocytes are cultured together resulting in an immune response and corresponding T cell proliferation, activation, and exhaustion (from upregulation of checkpoint receptors). T cells from 11 unique donors were mixed with DC cells from 2 unique donors to make 21 MLR reactions. 10 μg/ml XENP16432 (bivalent anti-PD-1 mAb based on nivolumab with PVA/S267K) was also added (to reverse T cell exhaustion) in the presence or absence of 1 ng/ml soluble TGFß1. 5 days post T cell seeding, release of IFNγ, proliferation of CD3+ T cells (as indicated by percentage Ki67+), and CD95 expression on CD3+ T cells were measured as depicted in FIG. 17. The data show that PD-1 blockade enhances IFNγ secretion, CD3+ T cell proliferation, and CD95 expression. Notably, the presence of TGFß1 suppresses this effect.

B. Example 2: Anti-TGFßRII×Anti-PD1 Bispecific Antibodies

As described above, an anti-TGFßRII antibody which was in clinic resulted in systemic toxicity and uncontrolled cytokine release syndrome.

Immune checkpoint proteins such as PD-1 are up-regulated in tumor-infiltrating lymphocytes. According, anti-TGFßRII×anti-PD1 bispecific antibodies (bsAbs) were conceived to target TGFßRII blockade antibodies to the tumor environment and subsequently circumvent toxicity and increase therapeutic index.

1. TGFßRII Binding Domains

Illustrative TGFßRII binding domains are depicted in FIGS. 19 (as variable regions and CDRs) and 20 (as bivalent mAbs). It should be noted that TBRII-B is a single-domain antibody (or VHH antibody). Additionally, TBRII-A_H1_L1 and TBRII-A_H1.1_L1 differ in that a methionine in HCDR3 was removed in TBRII-A_H1.1_L1 (to avoid potential for oxidation).

To confirm binding to cell-surface TGFßRII, PBMCs were activated with 500 ng/mL plate-bound anti-CD3 (OKT3) for 48 hours then incubated with illustrative anti-TGFßRII mAbs XENP28297, XENP33038, and XENP33040 as well as commercial antibodies C-4 (sc-17991) and D-2 (sc-17799) (both from Santa Cruz Biotechnology, Dallax, TX) (all labeled with Alexa647). Data showing binding of the various mAbs to activated T cells are depicted in FIG. 21.

2. PD1 Binding Domains

As it would be useful to combine the anti-TGFßRII×anti-PD1 bsAbs of the invention with PD-1 blockade antibodies, or to administer anti-TGFßRII×anti-PD1 bsAbs of the invention subsequent to treatment with PD-1 blockade antibodies, it is important that the PD-1 targeting arm of the anti-TGFßRII×anti-PD1 bsAbs does not bind the same or similar epitope as the PD-1 blockade antibody. PD-1 blockade antibodies contemplated herein include, but are not limited to, nivolumab and pembrolizumab.

Illustrative non-competing anti-PD-1 binding domains contemplated for use in the anti-TGFßRII×anti-PD1 bsAbs of the invention are referred to as mAb A, mAb B, and mAb C (sequences for their humanized variable regions are depicted as SEQ ID NOs: 115-130, 483-524 and 940-989, humanized using string content optimization (see, e.g., U.S. Pat. No. 7,657,380, issued Feb. 2, 2010)).

Tandem epitope binning was performed to demonstrate that the mAbs did not compete with nivolumab and pembrolizumab. Epitope binning was performed using the Octet HTX instrument. AMC (anti-mouse Fc) biosensors were first used to capture murine-Fc fusions of human PD-1, dipping into 100 nM of a first antibody (indicated on the left side of FIG. 23) and then dipped into 100 nM of a second antibody (indicated on the top of FIG. 23). BLI-responses were normalized against the BLI-response of dipping the biosensor into HBS-EP buffer followed by dipping into the anti-PD-1 antibody. If the antibody pair provided a normalized BLI-response less than 0.5, the pair was considered competing or partially competing and to be in the same epitope bin, i.e., recognizing very similar, or largely overlapping, epitopes. If the antibody pair provided a normalized BLI-response greater than 0.5, the pair was considered non-competing and to bin to different epitopes. Antibodies tested were a bivalent anti-PD-1 mAb based on nivolumab, in-house produced pembrolizumab, chimeric mAb A, chimeric mAb B, and chimeric mAb C. PD-L1-Fc was also included to investigate the blocking of PD-1:PD-L1 interaction by the antibodies. The binning shows that anti-PD-1 mAb A, mAb B, and mAb C do not compete with nivolumab or pembrolizumab. Additionally, mAb A does not appear to block the PD-1:PD-L1 interaction, while mAb B and mAb C are partial blockers of the PD-1:PD-L1 interaction.

However, PD1 binding domains which do compete for binding with PD-1 blockade antibodies such as nivolumab and pembrolizumab may still be suitable for use in the anti-TGFßRII×anti-PD1 bsAbs. Accordingly, additional PD1 binding domains contemplated for use are depicted as SEQ ID NOs: 131-482.

3. Engineering Prototype Anti-TGFßRII×Anti-PD1 bsAbs

Various formats for the anti-TGFßRII×anti-PD1 bsAbs of the invention were conceived and generated including bsAbs in the 1+1 Fab-scFv-Fc format (as depicted schematically in FIG. 14A; illustrative sequences for which are depicted in FIG. 24), the 1+1 Fab-VHH-Fc format (as depicted schematically in FIG. 14B; illustrative sequences for which are depicted in FIG. 25), and the 1+1 VHH-scFv-Fc format (as depicted schematically in FIG. 14C; illustrative sequences for which are depicted in FIG. 26). Additional formats for the anti-TGFßRII×anti-PD1 bsAbs of the invention were also conceived to tune the efficacy, potency, and/or selectivity of the bsAbs, including higher valency formats as depicted schematically in FIG. 15.

Additionally, αRSV×αPD1 bsAbs were constructed to act as a surrogate for investigating the behavior of αTGFßRII×αPD1 bsAbs outside of the tumor environment, illustrative sequences for which are depicted in FIG. 27.

C. Example 3: Anti-TGFßRII×Anti-PD-1 Bispecific Antibodies are Active In Vitro

1. Anti-TGFßRII×Anti-PD1 bsAbs Block SMAD2/3 Phosphorylation

Using the pSMAD2/3 assay described above, the biological activity of the prototype anti-TGFßRII×anti-PD1 bsAbs were investigated and compared with anti-TGFßRII mAbs. Human PBMC was seeded on 0.5 μg/ml anti-CD3 for 48 hours for activation, then serum deprived for 16 hours in 0.1% FBS (to remove confounding effect of TGFß in serum). The PBMC was then incubated with 20 μg/ml test articles (including E-6 (sc-17792) and D-2 (sc-17799) from Santa Cruz Biotechnology) for 30 minutes at room temperature followed by incubation with 10 μg/ml test articles and indicated dose of TGFß1 for 30 minutes at 37° C. Following incubation, intracellular phospho-flow cytometry was performed to measure phosphorylated SMAD2/3 (pSMAD2/3). The data as depicted in FIG. 28-31 show that the anti-TGFßRII×anti-PD1 bsAbs blocked TGFß1 activity as indicated by decreased potency of TGFß1 in inducing SMAD2/3 phosphorylation following incubation with the bsAbs. Notably, the anti-TGFßRII×anti-PD1 bsAbs having anti-TGFßRII arms based on TBRII-A and TBRII-B show superior blocking of TGFß1-induced SMAD2/3 phosphorylation on CD4+ and CD8+ T cells compared to corresponding anti-TGFßRII mAbs and anti-TGFßRII×anti-RSV bsAbs indicating that the PD-1-targeting enhances the blocking activity. However, the PD-1 targeting effect was less pronounced/non-existent in B cells and NK cells. Surprisingly, the TGFßRII binding domain TBRII-C was unable to block TGFß1-induced SMAD2/3 phosphorylation both in the context of a bivalent mAb and in the context of an anti-TGFßRII×anti-PD1 bsAb indicating that not all TGFßRII binders are able to block the activity of TGFß.

In another pSMAD2/3 assay, human PBMCs were activated by seeding on 0.5 μg/ml anti-CD3 for 48 hours, then serum deprived for 16 hours (0.1% FBS). The PBMCs were then incubated with test articles for 30 minutes at room temperature followed by incubation with test articles+1 ng/ml TGFß1 for 30 minutes at 37° C. Following incubation, intracellular phospho-flow cytometry was performed to measure phosphorylated SMAD2/3 (pSMAD2/3). The data as depicted in FIG. 32 show that the anti-TGFßRII×anti-PD1 bsAbs dose dependently blocks TGFß1-induced SMAD2/3 phosphorylation. Notably, the αPD1 bispecifics show superior blocking compared to αRSV bispecifics suggesting that in a clinical setting, the anti-TGFßRII×anti-PD1 bsAbs should be active in the tumor environment, while remaining substantially inactive outside of the tumor environment. Interestingly in comparing the activity of XENP34287 and XENP34288 with XENP33045, it appears that using a Fab domain for PD-1 targeting enhances the potency of the anti-TGFßRII×anti-PD1 bsAbs.

2. Anti-TGFßRII×Anti-PD1 bsAbs Block Suppressive Effects of TGFß

Next, the ability of the anti-TGFßRII×anti-PD1 bsAbs to reverse/block the suppressive effects of TGFß1 was investigated using the MLR assay as described above. T cells from 11 unique donors were mixed with DC cells from 2 unique donors to make 21 MLR reactions. 10 μg/ml of indicated test articles was also added in the presence or absence of 1 ng/ml soluble TGFß1. 5 days post T cell seeding, release IFNγ, proliferation of CD3+ T cells (as indicated by percentage Ki67+), and CD95 expression on CD3+ T cells were measured as depicted in FIGS. 33-35. Consistent with the data above, the data here show not only that the anti-TGFßRII×anti-PD1 bsAbs blocked the suppressive effect of TGFß1, but also that the anti-TGFßRII×anti-PD1 bsAbs having anti-TGFßRII arms based on TBRII-A and TBRII-B show superior blocking of TGFß1-induced suppression compared to corresponding anti-TGFßRII mAbs. Notably, the data shows that XENP33045 and XENP33046 respectively in combination with XENP16432 enhanced T cell activity in comparison to XENP33045 or XENP33046 alone indicating that the anti-TGFßRII×anti-PD1 bsAbs of the invention combine productively with PD-1 blockade.

3. Anti-TGFßRII×Anti-PD1 bsAbs Enables Superior Blockade in Comparison to Corresponding Monospecific Anti-TGFßRII mAb at Higher TGFß1 Concentrations In an experiment comparing the blockade efficacy of anti-TGFßRII×anti-PD1 bsAbs in comparison to monospecific anti-TGFßRII mAbs at higher TGFß1 concentrations, PBMCs were first activated by seeding on 0.5 μg/ml anti-CD3 for 48 hours, then serum deprived for 16 hours (0.1% FBS). The PBMCs were then incubated with test articles for 30 minutes at room temperature followed by incubation with test articles+10 ng/ml or 100 ng/ml TGFß1 for 30 minutes at 37° C. Following incubation, intracellular phospho-flow cytometry was performed to measure phosphorylated SMAD2/3 (pSMAD2/3). The data as depicted in FIG. 36 show that at higher concentrations of TGFß1, anti-TGFßRII×anti-PD1 bsAb based on TBRII-A is more effective at blockade than corresponding monospecific anti-TGFßRII mAb based on TBRII-A.

4. Anti-TGFßRII×Anti-PD1 bsAbs are Highly Selective for Activated (PD1-High) T Cells To further investigate the selectivity of the anti-TGFßRII×anti-PD1 bsAbs of the invention, blocking experiments were performed utilizing unactivated (PD1 low) and activated PBMCs (PD1 high). For experiments utilizing unactivated PBMCs, PBMCs were thawed and recovered overnight for 24 hours, then serum deprived for 16 hours (in 0.1% FBS). In experiments utilizing activated PBMCs, PBMCs were activated by seeding on 0.5 μg/ml anti-CD3 for 48 hours, then serum deprived for 16 hours (in 0.1% FBS). In both types of experiments, following serum deprivation, PBMCs were incubated with the test articles at indicated concentrations for 30 minutes at room temperature followed by incubation with the test articles+1 ng/ml TGFß1 for 30 minutes at 37° C. The data as depicted in FIG. 57 show that blocking activity is highly selective for activated (PD1-high) T cells over unactivated (PD1-low) T cells. Additionally, the bispecifics show stronger selectivity in CD45RA−CD45RO+ populations compared to CD45RA+CD45RO− populations (data not shown). As in Example 3A, the data here suggest that in a clinical setting, the anti-TGFßRII×anti-PD1 bsAbs should be active in the tumor environment, while remaining substantially inactive outside of the tumor environment.

D. Example 4: Anti-TGFßRII×Anti-PD1 Bispecific Antibodies are Active In Vivo

1. Anti-TGFßRII×Anti-PD1 Bispecific Antibodies Enhance GVHD

The anti-TGFßRII×anti-PD1 bsAbs were evaluated in a Graft-versus-Host Disease (GVHD) model conducted in NSG (NOD-SCID-gamma) immunodeficient mice. When the NSG mice are engrafted with human PBMCs, the human PBMCs develop an autoimmune response against mouse cells and subsequently GVHD. As such, GVHD is a model for potential anti-tumor response. Treatment of huPBMC-engrafted NSG mice with anti-TGFßRII×anti-PD1 bsAbs should enhance proliferation and response of the engrafted T cells and enhance GVHD.

Accordingly in a pilot study, NSG mice were engrafted with 10×106 human PBMCs via IV-OSP on Day −1 and dosed intraperitoneally with XENP16432 (a bivalent anti-PD1 mAb based on nivolumab with PVA_S267K; a checkpoint inhibitor which enhances GVHD by de-repressing the engrafted human T cells), anti-TGFßRII mAb XENP28296 (clone TBRII-A_H1L1), XENP28296 in combination with XENP16432, and prototype anti-TGFßRII×anti-PD1 mAb XENP33045 in combination with XENP16432 on Days 0, 7, 14, and 20. Body weights were assessed twice per week as an indicator of GVHD (change in body weight as a percentage of initial body weight depicted in FIG. 37), and blood was drawn on Days 7, 14, and 20 to assess cytokine secretion (data for which are depicted in FIG. 38).

The data show that both XENP28296 in combination with PD-1 blockade and XENP33045 in combination with PD-1 blockade significantly enhanced body weight loss by Day 13 in comparison to no treatment (i.e. PBS). Notably, by Day 17, XENP33045 in combination with PD-1 blockade significantly enhanced body weight loss in comparison to both PD-1 blockade alone as well as XENP28296 in combination with PD-1 blockade; and by Day 20, all mice treated with XENP33045 in combination with PD-1 blockade were dead. Finally, the data show that the test articles enhanced secretion of IFNγ and IL-10; and notably, XENP33045 in combination with PD-1 blockade induced significantly enhanced secretion of IFNγ by Day 7 in comparison to XENP28296 in combination with PD-1 blockade (statistics on log-transformed data). In a similar GVHD study, XENP34228 was found to promote significantly more GVHD weight loss, T cell expansion, and IFNγ release than PBS control or PD-1 blockade alone.

2. Anti-TGFßRII×Anti-PD1 Bispecific Antibodies Enhance Anti-Tumor Activity

To investigate anti-tumor activity of the anti-TGFßRII×anti-PD1 bsAbs, NSG mice that were MHC (NSG-DKO) and thus resistant to GVHD were used. NSG-DKO mice (10 per group) were intradermally inoculated with 2×106 pp65-transduced MDA-MB231 cells on Day −22. Mice were then intraperitoneally injected with 5×106 human PBMCs and treated with the indicated test articles/test article combinations on Day 0, and further treated on Days 8, 14, 21, and 28. Tumor volume was measured by caliper one to three times per week, body weights were measured once per week, and blood was drawn once per week.

Tumor volume on Days 20, 22, 25, 27, 29, 32, 34, and 36 as well as over time are depicted in FIGS. 39-40 (statistics performed on baseline corrected data using Mann-Whitney test). The data show that by Day 20, all of the TGFßRII blockade test article induced enhanced anti-tumor activity compared to no treatment. Notably by Day 25, TGFßRII blockade in combination with PD-1 blockade enhanced anti-tumor activity in comparison to TGFßRII blockade alone; and by Day 34, TGFßRII blockade in combination with PD-1 blockade additionally enhanced anti-tumor activity in comparison to PD1 blockade alone.

Data depicting the expansion of various lymphocyte population on Day 8 are depicted in FIG. 41. The data show that combination of anti-TGFßRII×anti-PD1 bispecific antibody with PD-1 blockade enabled significantly enhanced early expansion of lymphocytes (CD5+, CD3+, and CD8+) in comparison to treatment with PD-1 blockade alone.

Collectively, this experiment show that anti-TGFßRII× anti-PD1 bispecific antibodies effectively enhance anti-tumor activity. Notably, the experiment also indicates that anti-TGFßRII×anti-PD1 having a non-competing PD-1 binding arm combines synergistically with PD-1 blockade.

E. Example 5: Engineering TGFßRII Binding Domains for Stability and Binding Affinity TGFßRII binding domains described in Example 2A were engineered for enhanced stability in the context of an scFv for use in the bispecific antibody formats of the invention; and for modulated binding affinity to mitigate target-mediated drug disposition (TMDD) and to tune the efficacy, potency, and/or selectivity of the bispecific antibodies.

1. Round 1 Engineering

In a first round of engineering, variants of TBRII-A were engineered by introducing single or double mutations into the variable heavy region (VH) and the variable light region (VL) to generate 106 VH variants and 61 VL variants (sequences for which are depicted in SEQ ID NOs:1325-1430 TBRII-A_H1.2–TBRII-A_H1.107 and in SEQ ID NOs:1607-1667 as TBRII-A_L1.1–TBRII-A_L1.61).

His-tagged Fab domains, His-tagged scFvs, and TGFßRII bispecific antibodies (sequences depicted in FIGS. 24-26 and 64-66) comprising the variant VHs and variant VLs were produced and investigated as described below.

a. Stability of Variants

Stability of scFvs, Fabs, and bispecific antibodies comprising the variant VHs or VLs were evaluated using Differential Scanning Fluorimetry (DSF). DSF experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures (Tm) were calculated using the instrument software. The stability results are depicted in FIGS. 42 and 43. Collectively, the data show that a number of point mutations were identified which enabled increased stability, in the context of Fabs but also more relevantly in the context of scFvs.

b. Binding Affinity of Variants

In a first experiment, binding affinity of the TBRII-A variants formatted as His-tagged Fabs for TGFßRII was screened using Octet, a BioLayer Interferometry (BLI)-based method. Experimental steps for Octet generally include the following: Immobilization (capture of ligand to a biosensor); Association (dipping of ligand-coated biosensors into wells containing the analyte); and Dissociation (returning of biosensors to well containing buffer). The resulting apparent dissociation constant ($K_D$), association rate (ka), dissociation rate (kd), as well as sensorgram response are depicted in FIG. 44.

In further experiments, binding affinity of select TBRII-A variants formatted as αTGFßRII×αPD1 or αTGFßRII× αRSV bsAbs for human TGFßRII (as well as for cynomolgus TGFßRII, as similar binding to cynomolgus antigen is useful for ease of clinical development) was screened using Octet as generally described above. The resulting apparent dissociation constant (KD), association rate (ka), dissociation rate (kd), as well as sensorgram response are depicted in FIGS. 45-48.

Collectively, the data show that a number of point mutations were identified which resulted in modulated binding affinity for TGFßRII, both in the context of Fabs but also more relevantly in the context of bispecific antibodies.

2. Reduced Affinity TGFßRII Binding Reduces the Potency of αTGFßRII×αPD1 Bispecific Antibodies The effect of reduced affinity TGFßRII binding was investigated using a pSMAD2/3 assay as generally described above. PBMCs were first activated by seeding on 0.5 μg/ml anti-CD3 for 48 hours, then serum deprived for 16 hours (0.1% FBS). The PBMCs were then incubated with test articles for 30 minutes at room temperature followed by incubation with test articles+1 ng/ml TGFß1 for 30 minutes at 37° C. Following incubation, intracellular phospho-flow cytometry was performed to measure phosphorylated SMAD2/3 (pSMAD2/3). The data depicted in FIGS. 49-50 show that potency of the bispecific antibodies correlates with their TGFßRII binding affinity with tighter affinity correlating with stronger blockade.

3. Further Engineering

In further rounds of engineering, additional VH variants and VL variants were engineered by combining substitutions identified in Example 5A as favorably enhancing stability (i.e. those that enable $T_m$>60° C.) or modulating binding affinity with an aim to identify variants having a $T_m$>70° C. (vs. initial $T_m$ of 60° C.) while matching the affinity of the ladder identified in Round 1 Engineering (i.e. tighter affinity variants for more potent activity as well as weaker affinity variants aimed to reduce TMDD). Additionally, substitutions were explored to remove a possible VH oxidation site at Met109 (109L, T, V; Met98 in Kabat numbering), a possible VH deamidation motif NS Asn31Ser32 (31E, S, T, Q; 32A; *note: Asn31Ser32 in Kabat numbering), and a possible VL oxidation site Trp100 (100Y; Trp94 in Kabat numbering). The variant VHs were combined with WT VL and the variant VLs were combined with WT VH and formatted as His-tagged Fab domains and His-tagged scFvsto screen for stability and affinity. Notably, a core of E60G/S81N/P101A (as in H1.201 and H1.212; *note: E55G/S76N/P93A in Kabat numbering) was determined to provide minimal loss of affinity while providing high stability ($T_m$>70° C.); and are notably reversions to VH4-39 germline (which is expected to provide an additional benefit of reducing immunogenic potential). As described above, H1.201 further includes M109L (M98L in Kabat) and H1.212 further includes M109T (M98T in Kabat) to remove a potential oxidation site; and H1.201 further includes S32A (same in Kabat) while H1.212 further includes N31S (same in Kabat) to remove a deamidation motif. H1.212 further includes G37S (G35bS in Kabat) which was identified in Round 1 Engineering to enhance stability while decreasing TGFßRII binding affinity.

Affinity of illustrative such variants for TGFßRII were investigated in various contexts (e.g. in the context of αTGFßRII×αPD1 or αTGFßRII×αCD5) are depicted in FIGS. 51-53. In vitro activity of αTGFßRII×αPD1 bsAbs comprising illustrative such variants were investigated in SMAD2 phosphorylation assays using 1 ng/mL TGFß, data for which are depicted in FIG. 54. Consistent with the results from Round 1 Engineering, a gradient of affinity enabled a gradient of blockade potencies.

Additional engineering via the introduction of histidine substitutions was performed to generate pH-dependent variants. Weaker binding at low pH may allow for dissociation within the endosome after internalization and subsequent recycling to the cell surface by FcRn, thus lessening TMDD and improving pharmacokinetics. Alternatively, stronger binding at low pH may allow for selective binding and function in tumor microenvironments, which are often acidic.

Collectively, the further engineering generated an additional 175 VH variants and 36 VL variants (sequences for which are depicted in SEQ ID NOs: 1431-1605 as H1.108-H1.282 and in SEQ ID NOs: 1668-1703 as L1.62-L1.97).

4. VL-VH Swap

Another avenue explored was swapping the VH-VL orientation for the αTGFßR2 arm as in XENP35186. In the data shown in FIG. 55, it was found that bsAb having a VLVH scFv was ~2 fold less potent than bsAb having a VHVL scFv in inducing pSMAD2. It should be noted that this observation is consistent even in other contexts such as αTGFßRII×αCD5 bsAbs as depicted in FIG. 77.

F. Example 6: Engineering bsAbs by Modulating PD1 Binding Affinity

In addition to modulating affinity of the TGFßRII binding domain, modulating affinity of the PD-1 binding domain was also explored. In particular, the aim was to restore potency through the PD1 binding domain to compensate for reduced binding affinity of the TGFßRII binding domain. In the data shown in FIG. 56, it was found that bsAb having tightest PD-1 affinity was able increase blocking capacity by ~3 fold in CD8 T cells.

G. Example 7: Targeting TGFßRII Blockade Via CD5 Receptor

As described above, PD-1 is upregulated on TILs and so the anti-TGFßRII×anti-PD-1 bsAbs of the invention are selective for PD1-high TILs, and in particular, selective for activated T cells over unactivated T cells. However, it may also be useful in certain contexts to target broader T cell populations.

1. CD5 is Highly Expressed on Activated and Unactivated T Cells

CD5 has been reported as a highly expressed pan-T cell marker that is low or absent on most other immune cells. To confirm, CD5 expression level on numerous subsets of lymphocytes were analyzed (data depicted in FIGS. 58 and 59). The analysis found that CD5 levels are ~10-30-fold greater than PD1 levels on T cell subsets in unstimulated PBMCs and −4-7-folder greater than PD1 levels on T cell subsets in stimulated PBMCs (it should be noted that the ABC for PD1 was in the 10,000s range whereas the ABC for CD5 was in the 100,000s range). The observed expression profile of CD5 suggests that CD5 may be suitable for targeting the TGFßRII bispecific antibodies of the invention.

Additionally, in data not shown, it was found that TGFßRII bispecific antibodies internalize via TGFßRII and concomitantly induces internalization of the targeting receptor. Internalization of lower expressed targeting receptors may abrogate the ability of the targeted TGFßRII bispecific antibodies to bind their target cells. Targeting a highly expressed receptor such as CD5 may overcome this effect.

2. Anti-TGFßRII×Anti-CD5 Bispecific Antibodies a. CD5 Binding Domains

Sequences for illustrative CD5 binding domains which may find use in the anti-TGFßRII×anti-CD5 bispecific antibodies of the invention are depicted in FIGS. 61-63, FIG. 88, and SEQ ID NOs: 1-114, 1704-1757, 2137-2194, and 2355-2368.

b. Engineering Prototype Anti-TGFßRII×Anti-CD5 bsAbs

As described above, various formats for the anti-TGFßRII×anti-CD5 bsAbs of the invention were conceived and generated including bsAbs in the 1+1 Fab-scFv-Fc format (as depicted schematically in FIG. 14A; illustrative sequences for which are depicted in FIG. 62). Additional formats for the anti-TGFßRII×anti-CD5 bsAbs of the invention were also conceived to tune the efficacy, potency, and/or selectivity of the bsAbs, including higher valency formats as depicted schematically in FIG. 15. Sequences for illustrative anti-TGFßRII×anti-CD5 bsAbs in these various formats are depicted in FIGS. 64-66.

c. Cynomolgus CD5 Cross-Reactive Binding Domains

For ease of clinical development, it is useful to investigate various parameters of the targeted TGFßRII bsAbs such as pharmacodynamics, pharmacodynamics, and toxicity in cynomolgus monkeys.

A first CD5 mAb previously described in U.S. App. No. 2008/0254027 as 5D7 (sequences depicted in FIG. 61 as a bivalent mAb) showed promise as it bound both unstimulated human PBMCs and cynomolgus PBMCs (see FIG. 67). However, in the context of a bispecific antibody, the CD5 binding domain would only be able to monovalently engage CD5 receptors. Accordingly, the binding of several prototype anti-TGFßRII×anti-CD5 bsAbs having different CD5 binding domains to human and cynomolgus PBMCs was investigated.

First, the binding affinity of the bispecific antibodies for human and cynomolgus CD5 antigen were determined using Octet as generally described above. In particular, His-tagged human and cynomolgus CD5 antigen were captured using HIS1K sensors and dipped into multiple concentrations of the bispecific antibodies. The resulting dissociation constant (KD) are depicted in FIG. 68.

Next, cell binding of the bispecific antibodies were investigated. Unstimulated PBMCs were incubated with the indicated dose of bispecific antibodies for 1 hour on ice and washed. Next, the PBMCs were stained with goat anti-human Fc secondary antibody conjugated to Alexa647 (to assess binding of the bispecific antibodies) and antibodies against cell surface antigens (to define T cell populations) for 40 minutes on ice. Finally, the cells were analyzed by flow cytometry. As depicted in FIG. 69, it was found that while XENP35399 (a bsAb having a CD5-targeting arm based on 5D7; sequences depicted in FIG. 64) maintained binding to human PBMCs, binding to cynomolgus PBMCs was lost. On the other hand, the data as depicted in FIGS. 70-71 show that bsAbs based on Cd5-A and Cd5-B (variable region and CDR sequences depicted in FIGS. 62 and 63; sequences depicted in FIG. 64 as anti-TGFßRII×anti-CD5 bsAbs XENP37558 and XENP37388) maintained binding to both human and cynomolgus PBMCs.

3. Anti-TGFßRII×Anti-CD5 bsAbs Selectively Inhibit pSMAD Induction in a Broader T Cell Population Using the pSMAD2/3 assay described above, the biological activity of the prototype anti-TGFßRII×anti-CD5 antibodies were investigated and compared with anti-TGFßRII×anti-RSV controls and anti-TGFßRII×anti-PD1 bsAbs. In experiments utilizing unactivated PBMCs, PBMCs were thawed and recovered overnight for 24 hours, then serum deprived for 16 hours (in 0.1% FBS). In experiments utilizing activated PBMCs, PBMCs were activated by seeding on 0.5 μg/ml anti-CD3 for 48 hours, then serum deprived for 16 hours (in 0.1% FBS). In both types of experiments, following serum deprivation, PBMCs were incubated with the test articles at indicated concentrations for 30 minutes at room temperature followed by incubation with the test articles+1 ng/ml TGFß1 for 30 minutes at 37° C. Following incubation, intracellular phospho-flow cytometry was performed to measure phosphorylated SMAD2/3 phosphorylation following incubation with the bsAbs. Data are depicted in FIGS. 72-75.

Consistent with the above, the anti-TGFßRII×anti-PD1 bsAbs having anti-TGFßRII arms based on TBRII-A show superior blocking of TGFß1-induced SMAD2/3 phosphorylation on activated $CD4^{+}$ and $CD8^{+}$ T cells compared to corresponding control anti-TGFßRII×anti-RSV bsAbs indicating that the PD-1-targeting enhances the blocking activity. Notably, the anti-TGFßRII×anti-CD5 bsAbs demonstrated further enhanced blocking activity in comparison to the anti-TGFßRII×anti-PD1 bsAbs. Additionally, the anti-TGFßRII×anti-CD5 bsAbs demonstrated enhanced blocking activity on both activated PBMCs and unactivated PBMCs. Finally, it was noted that both the anti-TGFßRII×anti-PD-1 bsAb and the anti-TGFßRII×anti-CD5 bsAb demonstrated little to no blocking activity on B cells and NK cells (CD5 and PD1 low/negative) except at very high concentrations.

4. Reducing Affinity TGFßRII and CD5 Binding Reduces the Potency of αTGFßRII×αCD5 Bispecific Antibodies In another experiment, the biological activity of the additional anti-TGFßRII×anti-CD5 antibodies having alternative cynomolgus cross-reactive CD5-targeting arms as well as antibodies having reduced affinity TGFßRII binding were investigated. The experiment was performed as described above using activated PBMCs except using incubation with 10 ng/ml TGFß1.

The data as depicted in FIG. 76 show that the bsAbs based on anti-CD5 clone Cd5-A and Cd5-B also demonstrate blocking activity. Notably, XENP37385 which has a lower affinity CD5-targeting arm than XENP35399 and XENP37388 demonstrated weaker potency in blocking activity. Additionally, XENP36132 and XENP37401 which both have reduced TGFßRII binding also demonstrated weaker potency in blocking activity. Further, the data show that the αTGFßRII×αCD5 bsAbs block TGFß more potently than the αTGFßRII×αPD1 bsAbs and suggest that reduced potency resulting from reduction of TGFßRII binding affinity to mitigate TMDD can be restored by targeting more broadly expressed T cell markers such as CD5.

Additional αTGFßRII×αCD5 bsAbs were generated using the stability/affinity optimized variants identified in Example 5C. In vitro activity of αTGFßRII×αCD5 bsAbs comprising illustrative such variants were investigated in SMAD2 phosphorylation assays using 10 ng/mL TGFß, data for which are depicted in FIG. 77. Consistent with the results above, a gradient of affinity enabled a gradient of blockade potencies, including high potency variants including TBRII-A_H1.201_L1, and mid potency variants including TBRII-A_H1.212_L1.

5. Humanization CD5 Binding Domains

Murine Cd5-A and Cd5-B binding domains were humanized using string content optimization (see, e.g., U.S. Pat. No. 7,657,380, issued Feb. 2, 2010), respectively depicted as Cd5-A_H1L1 and Cd5-B_H1L1. αTGFßRII×αCD5 bsAbs based on these humanized binders were generated and investigated in SMAD2 phosphorylation assay as described above. Data are depicted in FIGS. 78 and 79. The data as depicted in FIG. 79 surprisingly show that humanization impairs Cd5-B capacity to block TGFß1-induced pSMAD but improves Cd5-A.

Binding of the murine, H1L1 humanized, and half-humanized (i.e. humanized VH+murine VL–H1L0 and murine VH+humanized VL–H0L1) Cd5-B Fvs were investigated in Octet, sensorgram depicted in FIG. 80. The data show that H1L1 and H1L0 had impaired binding in comparison to H0L0 and H0L1, indicating that humanization of the VH impaired CD5 binding affinity. As demonstrated in Example 6 and Example 7D, modulating the binding affinity of the targeting arm can tune blocking potency of the αTGFßRII bispecifics. Accordingly, further humanized variants of Cd5-B VH were engineered with the aim to restore binding affinity. Such sequences are depicted as SEQ ID NOs: XX-YY, and illustrative variants H2L1 (2 nM for human TGFßRII; 0.3 nM for cyno TGFßRII), H1.23_L1 (4 nM for human TGFßRII; 3 nM for cyno TGFßRII), and H1.36_L1 (4 nM for human TGFßRII; 2 nM for cyno TGFßRII) are depicted in FIG. 63.

6. Anti-TGFßII×Anti-CD5 bsAbs are Active In Vivo and Combine with PD-1 Blockade

As above, the anti-TGFßRII×anti-CD5 bsAbs were evaluated in a Graft-versus-Host Disease (GVHD) model conducted in NSG (NOD-SCID-gamma) immunodeficient mice. NSG mice were engrafted with $10\times10^{6}$ human PBMCs via IV-OSP on Day −1 and dosed intraperitoneally with XENP16432 (a bivalent anti-PD1 mAb based on nivolumab with PVA_S267K; a checkpoint inhibitor which enhances GVHD by de-repressing the engrafted human T cells), anti-TGFßRII mAb XENP28297 (clone TBRII-A_H1.1_L1), prototype anti-TGFßRII×anti-CD5 mAb XENP35399 alone or in combination with XENP16432, and TGFßRII affinity-reduced anti-TGFßRII×anti-CD5 mAb XENP36132 alone or in combination with XENP16432 on Days 0, 8, and 16. Body weights were assessed twice per week as an indicator of GVHD (change in body weight as a percentage of initial body weight depicted in FIG. 81). The data show that both XENP35399 and XENP36132 enhanced GVHD in comparison to PD-1 blockade alone or TGFßRII blockade alone. Notably, adding PD-1 blockade to the anti-TGFßRII×anti-CD5 bsAbs of the invention further enhances GHVD indicating productive combination with PD-1 blockade. In another GVHD study, anti-TGFßRII× anti-CD5 bsAbs having Cd5-A and Cd5-B binding domains were investigated. The data as depicted in FIG. 82 show that each of the additional bsAbs were active in comparison to PBS control and combined productively with PD-1 blockade.

In a mouse tumor model, activity of anti-TGFßRII×anti-CD5 bsAbs XENP40323 and XENP39131 having humanized (affinity-fixed) Cd5-B binding domain and stability/affinity-optimized TGFßRII binding domain (respectively high potency H1.201_L1 or mid-potency H1.212_L1) binding domains were investigated. On Day −16, NSG-DKO mice (n=10) were inoculated intradermally with $5\times10^{6}$ pp65-MDA-MB231 cancer cells. On Day 0, mice were intraperitoneally engrafted with $5\times10^{6}$ huPBMCs. Mice were dosed with indicated test articles at indicated concentrations on Days 0, 7, and 14. Blood was drawn over time to investigate lymphocyte expansion and tumor size was measured by caliper. The data as depicted in FIGS. 83-84 show that the bsAbs as single agent enhance lymphocyte expansion over PBS control (2-3 fold expansion of CD45 cell counts by Day 14; 4 fold expansion of CD4 cell count by Day 14; 3 fold expansion of CD8 cell count by Day 14). Combination with PD-1 blockade enhanced CD4 cell expansion 6-7 fold over PBS control by Day 14. Notably, combination with PD-1 blockade enables earlier (Day 7) enhanced lymphocyte expansion in comparison to PD-1 blockade alone. By Day 21 (as depicted in FIG. 90), both XENP40323 and XENP39131 in combination with PD-1 blockade significantly enhanced CD8 expansion over PD-1 blockade alone. Further, the data as depicted in FIG. 85 show that that bsAbs as single agent significantly enhance anti-tumor activity over PBS control by Day 15. Notably, by Day 22, XENP40323 in combination with PD-1 blockade significantly enhanced anti-tumor activity over PD-1 blockade alone; and by Day 27, XENP39131 in combination with PD-1 blockade also enhanced anti-tumor activity over PD-1 blockade alone. IFNγ levels in serum was also assessed (as depicted in FIG. 91), and it was found that by Day 7, both XENP40323 having higher affinity TGFßRII binding domain (TBRII-A_H1.201_L1) and XENP39131 having lower affinity TGFßRII binding domain (TBRII-A_H1.212_L1) enhanced IFNγ secretion over PBS control; further, both bsAbs in combination with PD-1 blockade enhanced IFNγ secretion over PD-1 blockade alone. Additional findings (data not shown) are that the αTGFßRII×αCD5 bsAbs show selective TGFßRII and CD5 occupancy on T cells, upregulation of CD69, CD25, PD1, and NKG2D in T cells (association with T cell activation), and increased KLRG1 levels which is consistent with TGFß blockade.

SEQUENCE LISTING (2430 sequences)

SEQ ID NO: 1 - protein, 120 aa, Artificial Sequence
  Description of Artificial Sequence: Synthetic polypeptide
  Humanized 5D7 Variable heavy (vh) domain
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 2 - protein, 7 aa, Artificial Sequence
  Description of Artificial Sequence: Synthetic peptide
  Humanized 5D7 vhCDR1
TSGMGVG

SEQ ID NO: 3 - protein, 16 aa, Artificial Sequence
  Description of Artificial Sequence: Synthetic peptide
  Humanized 5D7 vhCDR2
HIWWDDDVYYNPSLKS

SEQ ID NO: 4 - protein, 10 aa, Artificial Sequence
  Description of Artificial Sequence: Synthetic peptide
  Humanized 5D7 vhCDR3
RRATGTGFDY

SEQ ID NO: 5 - protein, 106 aa, Artificial Sequence
  Description of Artificial Sequence: Synthetic polypeptide
  Humanized 5D7 Variable light (vl) domain
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 6 - protein, 11 aa, Artificial Sequence
  Description of Artificial Sequence: Synthetic peptide
  Humanized 5D7 vlCDR1
QASQDVGTAVA

SEQ ID NO: 7 - protein, 7 aa, Artificial Sequence
  Description of Artificial Sequence: Synthetic peptide
  Humanized 5D7 vlCDR2
WTSTRHT

SEQ ID NO: 8 - protein, 8 aa, Artificial Sequence
  Description of Artificial Sequence: Synthetic peptide
  Humanized 5D7 vlCDR3
HQYNSYNT

SEQ ID NO: 9 - protein, 120 aa, Artificial Sequence
  Description of Artificial Sequence: Synthetic polypeptide
  Magenta Consensus Fv Variable heavy (vh) domain
EVQLVESGGGLVQPGGSLRLSCAASGFTFSDYAMSWVRQAPGKGLEWVAVISENGSDTYYADSVKGRFTISRDDSKNTLYLQMNSLRAEDTAVYYCARDRGGAVSYFDVWGQGTLVTVSS

SEQ ID NO: 10 - protein, 5 aa, Artificial Sequence
  Description of Artificial Sequence: Synthetic peptide
  Magenta Consensus Fv vhCDR1
DYAMS

SEQ ID NO: 11 - protein, 17 aa, Artificial Sequence
  Description of Artificial Sequence: Synthetic peptide
  Magenta Consensus Fv vhCDR2
VISENGSDTYYADSVKG

SEQ ID NO: 12 - protein, 11 aa, Artificial Sequence
  Description of Artificial Sequence: Synthetic peptide
  Magenta Consensus Fv vhCDR3
DRGGAVSYFDV

SEQ ID NO: 13 - protein, 107 aa, Artificial Sequence
  Description of Artificial Sequence: Synthetic polypeptide
  Magenta Consensus Fv Variable light (vl) domain
DIQMTQSPSSLSASVGDRVTITCRASQDVSSYLAWYQQKPGKAPKLLIYAASSLESGVPSRFSGSGSGTDFTLTISSLQPEDFATYYCQQYNSLPYTFGQGTKVEIK

SEQ ID NO: 14 - protein, 11 aa, Artificial Sequence
  Description of Artificial Sequence: Synthetic peptide
  Magenta Consensus Fv vlCDR1
RASQDVSSYLA

SEQ ID NO: 15 - protein, 7 aa, Artificial Sequence
  Description of Artificial Sequence: Synthetic peptide
  Magenta Consensus Fv vlCDR2
AASSLES

SEQ ID NO: 16 - protein, 9 aa, Artificial Sequence
  Description of Artificial Sequence: Synthetic peptide
  Magenta Consensus Fv vlCDR3
QQYNSLPYT

SEQ ID NO: 17 - protein, 118 aa, Artificial Sequence
  Description of Artificial Sequence: Synthetic polypeptide
  Magenta Ab X Variable heavy (vh) domain
QIQLVQSGPGLKKPGGSVRISCAASGYTFTNYGMNWVKQAPGKGLRWMGWINTHTGEPTYADDFKGRFTFSLDTSKSTAYLQINSLRAEDTATYFCTRRGYDWYFDVWGQGTTVTVSS

SEQ ID NO: 18 - protein, 5 aa, Artificial Sequence
  Description of Artificial Sequence: Synthetic peptide
  Magenta Ab X vhCDR1
NYGMN

SEQ ID NO: 19 - protein, 17 aa, Artificial Sequence
  Description of Artificial Sequence: Synthetic peptide
  Magenta Ab X vhCDR2
WINTHTGEPTYADDFKG

SEQ ID NO: 20 - protein, 9 aa, Artificial Sequence
  Description of Artificial Sequence: Synthetic peptide
  Magenta Ab X vhCDR3
RGYDWYFDV

SEQ ID NO: 21 - protein, 107 aa, Artificial Sequence
  Description of Artificial Sequence: Synthetic polypeptide
  Magenta Ab X Variable light (vl) domain
DIQMTQSPSSMSASLGDRVTITCRASQDINSYLSWFQQKPGKSPKTLIYRANRLVDGVPSRFSGSGSGTDYTLTISSLQYEDFGIYYCQQYDESPWTFGGGTKLEIK

SEQ ID NO: 22 - protein, 11 aa, Artificial Sequence
  Description of Artificial Sequence: Synthetic peptide
  Magenta Ab X vlCDR1
RASQDINSYLS

SEQ ID NO: 23 - protein, 7 aa, Artificial Sequence
  Description of Artificial Sequence: Synthetic peptide
  Magenta Ab X vlCDR2
RANRLVD

SEQ ID NO: 24 - protein, 9 aa, Artificial Sequence
  Description of Artificial Sequence: Synthetic peptide
  Magenta Ab X vlCDR3
QQYDESPWT

SEQ ID NO: 25 - protein, 119 aa, Artificial Sequence
  Description of Artificial Sequence: Synthetic polypeptide
  Magenta Ab Y Variable heavy (vh) domain
EIQLVQSGGGLVKPGGSVRISCAASGYTFTNYGMNWVRQAPGKGLEWMGWINTHYGEPTYADSFKGTRTFSLDDSKNTAYLQINSLRAEDTAVYFCTRRGYDWYFDVWGQGGTTVTVSS

SEQ ID NO: 26 - protein, 5 aa, Artificial Sequence
  Description of Artificial Sequence: Synthetic peptide
  Magenta Ab Y vhCDR1
NYGMN

SEQ ID NO: 27 - protein, 17 aa, Artificial Sequence
  Description of Artificial Sequence: Synthetic peptide
  Magenta Ab Y vhCDR2
WINTHYGEPTYADSFKG

SEQ ID NO: 28 - protein, 9 aa, Artificial Sequence
  Description of Artificial Sequence: Synthetic peptide
  Magenta Ab Y vhCDR3
RGYDWYFDV

SEQ ID NO: 29 - protein, 107 aa, Artificial Sequence
  Description of Artificial Sequence: Synthetic polypeptide
  Magenta Ab Y Variable light (vl) domain
DIQMTQSPSSLSASVGDRVTITCRASQDINSYLSWFQQKPGKAPKTLIYRANRLESGVPSRFSGSGSGTDYTLTISSLQYEDFGIYYCQQYDESPWTFGGGTKLEIK

SEQ ID NO: 30 - protein, 11 aa, Artificial Sequence
  Description of Artificial Sequence: Synthetic peptide
  Magenta Ab Y vlCDR1
RASQDINSYLS

SEQ ID NO: 31 - protein, 7 aa, Artificial Sequence
  Description of Artificial Sequence: Synthetic peptide
  Magenta Ab Y vlCDR2
RANRLES

SEQ ID NO: 32 - protein, 9 aa, Artificial Sequence
  Description of Artificial Sequence: Synthetic peptide
  Magenta Ab Y vlCDR3
QQYDESPWT

SEQ ID NO: 33 - protein, 118 aa, Artificial Sequence
  Description of Artificial Sequence: Synthetic polypeptide
  MAT304 Variable heavy (vh) domain
EVQLQESGPGLVKPSQTLSLTCSVTGYSITSGYYWHWIRQFPGNKLEWMGYISYSGFTNYKTSLINRISITHDTSENQFFLNLNSVTTEDTATYYCAGDRTGSWFAYWGQGTLVTVSA

SEQ ID NO: 34 - protein, 6 aa, Artificial Sequence
  Description of Artificial Sequence: Synthetic peptide
  MAT304 vhCDR1
SGYYWH

SEQ ID NO: 35 - protein, 16 aa, Artificial Sequence
  Description of Artificial Sequence: Synthetic peptide
  MAT304 vhCDR2
YISYSGFTNYKTSLIN

SEQ ID NO: 36 - protein, 9 aa, Artificial Sequence
  Description of Artificial Sequence: Synthetic peptide
  MAT304 vhCDR3
DRTGSWFAY

SEQ ID NO: 37 - protein, 107 aa, Artificial Sequence
  Description of Artificial Sequence: Synthetic polypeptide
  MAT304 Variable light (vl) domain
DIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIK

SEQ ID NO: 38 - protein, 11 aa, Artificial Sequence
  Description of Artificial Sequence: Synthetic peptide
  MAT304 vlCDR1
RTSQDISNYLN

SEQ ID NO: 39 - protein, 7 aa, Artificial Sequence
  Description of Artificial Sequence: Synthetic peptide
  MAT304 vlCDR2
ATSSLDS

SEQ ID NO: 40 - protein, 9 aa, Artificial Sequence
  Description of Artificial Sequence: Synthetic peptide
  MAT304 vlCDR3
LQYASYPFT

SEQ ID NO: 41 - protein, 109 aa, Artificial Sequence
  Description of Artificial Sequence: Synthetic polypeptide
  Symphogen Ab 1 Variable heavy (vh) domain
EVQLQESGPELVKPEASVKISCKASGYSFTGYTMNWVKQSHGKNLEWIGLINPYNGGTTYNQKFKGKATLTVDTSSSTAFMELLSLTSEDSAVYYCARDYYGSSPDFDY

SEQ ID NO: 42 - protein, 97 aa, Artificial Sequence
  Description of Artificial Sequence: Synthetic polypeptide
  Symphogen Ab 1 Variable light (vl) domain
DIVLTQSTSSLSASLGDRVTINCSASQGISNHLNWFQQKSDGTVKLLIYFTSSLHSGVPSRFSGSGSGTDYSLTISNLEPEDIAAYYCQQYSNLPYT

SEQ ID NO: 43 - protein, 109 aa, Artificial Sequence
  Description of Artificial Sequence: Synthetic polypeptide
  Symphogen Ab 2 Variable heavy (vh) domain
EVQLQQPGPELVKPGASMKISCKASGYSFTDYTMNWVKQSHGKNLEWIGLINPYNGGTMYNQKFKDKATLTVDKSSNTAYMELLSLTSEDSAVYYCARDNYGSSPDFDY

SEQ ID NO: 44 - protein, 97 aa, Artificial Sequence
  Description of Artificial Sequence: Synthetic polypeptide
  Symphogen Ab 2 Variable light (vl) domain
NIVLTQSTSSLSASLGDRVTISCSASQGIRNYLNWYQQKSDGTVKLLIYFTSSLHSGVPSRFSGSGSGTDYSLTISNLEPEDIAAYYCQQYSNLPYT

SEQ ID NO: 45 - protein, 109 aa, Artificial Sequence
  Description of Artificial Sequence: Synthetic polypeptide
  Symphogen Ab 3 Variable heavy (vh) domain
QVQLKESGPELVKPGASMKISCKASGYSFTGYTMNWVKQSHGKNLEWIGLINPYNGGTMYNQKFKGKATLTVDKSSNTAYMELLSLTSEDSAVYYCARDNYGSSPYFDY

SEQ ID NO: 46 - protein, 97 aa, Artificial Sequence
  Description of Artificial Sequence: Synthetic polypeptide
  Symphogen Ab 3 Variable light (vl) domain
NIVLTQSTSSLSASLGDRVTINCSASQGISNHLNWFQQKSDGTVKLLIYFTSSLHSGVPSRFSGSGSGTDYSLTISNLEPEDIAAYYCQQYSNLPYT

SEQ ID NO: 47 - protein, 109 aa, Artificial Sequence
  Description of Artificial Sequence: Synthetic polypeptide
  Symphogen Ab 4 Variable heavy (vh) domain
QVQLQESGPELVKPGASMKISCKASGYSFTGYTMNWVKQSHGKNLEWIGLINPYNGGTMYNQKFKGKATLTVDKSSNTAYMELLSLTSEDSAVYYCARDNYGSSPYFDY

SEQ ID NO: 48 - protein, 97 aa, Artificial Sequence
  Description of Artificial Sequence: Synthetic polypeptide
  Symphogen Ab 4 Variable light (vl) domain
DIVMTQSTSSLSASLGDRVTISCSASQGINNYLNWYQQKPDGTVKLLIYYTSSLHSGVPPRFSGSGSGTDYSLTISNLEPEDIATYYCQQYSKIPYT

SEQ ID NO: 49 - protein, 109 aa, Artificial Sequence
  Description of Artificial Sequence: Synthetic polypeptide
  Symphogen Ab 5 Variable heavy (vh) domain
EVKLVESGPELVKPEASVKISCKASGYSFTGYTMNWVKQSHGKNLEWIGLINPYNGGTTYNQKFKGKATLTVDTSSSTAFMELLSLTSEDSAVYYCARDYYGSSPDFDY

SEQ ID NO: 50 - protein, 97 aa, Artificial Sequence
  Description of Artificial Sequence: Synthetic polypeptide
  Symphogen Ab 5 Variable light (vl) domain
NIVLTQSTSSLSASLGDRVTINCSASQGISNHLNWFQQKSDGTVKLLIYFTSSLHSGVPSRFSGSWSGTDYSLTISNLEPEDIAAYYCQQYSNLPYT

SEQ ID NO: 51 - protein, 109 aa, Artificial Sequence
  Description of Artificial Sequence: Synthetic polypeptide
  Symphogen Ab 6 Variable heavy (vh) domain
QVQLQESGGVLVKPGGSLKLSCAASGFTFSNYAMSWVRQTPEKRLEWVASISSGGNTFYPDNVKGRFTISRDNSRNILYLQMTSLRSEDSAMYYCVRYYYGVTYWYFDV

SEQ ID NO: 52 - protein, 100 aa, Artificial Sequence
  Description of Artificial Sequence: Synthetic polypeptide
  Symphogen Ab 6 Variable light (vl) domain
NIVLTQSPASLAVSLGQRATISCKASQSVDHDGDSYMNWYQQKPGQSPKLLTYAASNLDSGIPARFSGSGSRTDFTLNIHPVEEEDAATYYCQQNYEDPT

SEQ ID NO: 53 - protein, 109 aa, Artificial Sequence
  Description of Artificial Sequence: Synthetic polypeptide
  Symphogen Ab 7 Variable heavy (vh) domain
EVQLVESGGGLVKPGGSLKLSCAASGFTFSSYAMSWVRQTPEKRLEWVASISSGGSTYYPDTVKGRFTISRDNARNILYLQMSSLRSEDTAMYYCVRYYYGIRYWYFDV

SEQ ID NO: 54 - protein, 100 aa, Artificial Sequence
  Description of Artificial Sequence: Synthetic polypeptide
  Symphogen Ab 7 Variable light (vl) domain
QIVLTQSPASLPASPGQRATISCKASQSVDYDGDSYMNWYHQKPGQPPKLLIYAASNLESGIPARFSGSGSGTDFTLNIHPVEEEDAATYYCQQSNEDPT

SEQ ID NO: 55 - protein, 110 aa, Artificial Sequence
  Description of Artificial Sequence: Synthetic polypeptide
  Symphogen Ab 8 Variable heavy (vh) domain
QVQLKESGPELEKPGASVRISCKASGYSFTAYNINWVTQRDGKSLEWIGSIDPYYGDTKYNQKFKDKATLTVDKSSSTAHMQVKSLTSEDSAIYYCARRMITMGDWYFDV

SEQ ID NO: 56 - protein, 97 aa, Artificial Sequence
  Description of Artificial Sequence: Synthetic polypeptide
  Symphogen Ab 8 Variable light (vl) domain
EIVLTQSPSSLSASLGDRVTISCRASQDISNYLNWYQRKPDGTVKLLIYYTSRLQSGVPSRFSGSGSGSEYSLTISNLDQEDIATYFCQQGDALPWT

SEQ ID NO: 57 - protein, 110 aa, Artificial Sequence
  Description of Artificial Sequence: Synthetic polypeptide
  Symphogen Ab 9 Variable heavy (vh) domain
QVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDV

SEQ ID NO: 58 - protein, 97 aa, Artificial Sequence
  Description of Artificial Sequence: Synthetic polypeptide
  Symphogen Ab 9 Variable light (vl) domain
HIVLTQSPSSLSASLGDRVTISCRASQDISTYLNWYQQKPDGTVKLLIFYTSRLHAGVPSRFSGSGSGTHHSLTISNLEQEDIATYFCQQGNSLPFT

SEQ ID NO: 59 - protein, 108 aa, Artificial Sequence
  Description of Artificial Sequence: Synthetic polypeptide
  Symphogen Ab 10 Variable heavy (vh) domain
QVQLKESGAELVRPGVSVKISCKGSGYTFTNFAIHWVKQSHAKSLEWIGLISSNSGDVSYNQKFKGKATMTVDKSSSTAYMELARLTSEDSAIYYCARHYGAHNYFDY

SEQ ID NO: 60 - protein, 98 aa, Artificial Sequence
  Description of Artificial Sequence: Synthetic polypeptide
  Symphogen Ab 10 Variable light (vl) domain
NIVMTQSPAIMSASPGEQVTMTCRATSSISSSYLHWYQQKSGASPKLWIYGTSNLASGVPTRFSGSGSGTSYSLTISSMEAEDAATYYCQQWSSRPPT

SEQ ID NO: 61 - protein, 108 aa, Artificial Sequence
  Description of Artificial Sequence: Synthetic polypeptide
  Symphogen Ab 11 Variable heavy (vh) domain
EVQLKESGAELVRPGGSVKISCKGSGYTFTNFAIHWVKQSHIKTLEWIGLISTSSGDVSYNQKFKDKATMTVDKSSSTAYMELARLTSEDSAIYYCARHYGANNYFDY

SEQ ID NO: 62 - protein, 98 aa, Artificial Sequence
  Description of Artificial Sequence: Synthetic polypeptide
  Symphogen Ab 11 Variable light (vl) domain
EIVLTQSPTIMSASPGEQVTMTCRTNSSVSSSYLHWYQQKSGASPKLWIYGTSNLASGVPTRFSGSGSGTSYSLTISSVEAGDAATYFCQQYSGYPLT

SEQ ID NO: 63 - protein, 108 aa, Artificial Sequence
  Description of Artificial Sequence: Synthetic polypeptide
  Symphogen Ab 12 Variable heavy (vh) domain
EVQLQESGAELVRPGVSVKISCKGSGYTFTNFAIHWVKQSHAKSLEWIGLISSNSGDVSYNQKFKGKATMTVDKSSSTAYMELARLTSEDSAIYYCARHYGAHNYFDY

SEQ ID NO: 64 - protein, 98 aa, Artificial Sequence
  Description of Artificial Sequence: Synthetic polypeptide
  Symphogen Ab 12 Variable light (vl) domain
DIVLTQSPAIMSASPGEQVTMTCRATSSISSSYLHWYQQKSGASPKLWIYGTSNLASGVPTRFSGSGSGTSYSLTISSVEAEDAATYYCQQYSDYPLT

SEQ ID NO: 65 - protein, 108 aa, Artificial Sequence
  Description of Artificial Sequence: Synthetic polypeptide
  Symphogen Ab 13 Variable heavy (vh) domain
QVQLQQSGAELVRPGVSVKISCKGSGYTFTNFAIHWVKQSHAKSLEWIGLISSNSGDVSYNQKFKGKATMTVDKSSSTAYMELARLTSEDSAIYYCARHYGAHNYFDY

SEQ ID NO: 66 - protein, 98 aa, Artificial Sequence
  Description of Artificial Sequence: Synthetic polypeptide
  Symphogen Ab 13 Variable light (vl) domain
EIVLTQSPAIMSASPGEQVTMTCRATSSISSSYLHWYQQKSGASPKLWIYGTSNLASGVPTRFSGGGSGTSYSLTISRMEAEDAATYYCQQRSYFPFT

SEQ ID NO: 67 - protein, 110 aa, Artificial Sequence
  Description of Artificial Sequence: Synthetic polypeptide
  Symphogen Ab 14 Variable heavy (vh) domain
EVQLKESGAELVKPGASVKLSCTASGFNIKDTYMHWVKQRPEQGLEWIGRIDPANGNTKYDPKFQGKATITADTSSNTAYLQLSSLTSEDTAVYYCAREENYYGTYYFDY

SEQ ID NO: 68 - protein, 97 aa, Artificial Sequence
  Description of Artificial Sequence: Synthetic polypeptide
  Symphogen Ab 14 Variable light (vl) domain
NIVLTQSPASLAASVGETVTITCRASENIYYNLAWYQQKQGKSPQLLIYNANSLEDGVPSRFSGSGSGTQYSMKINSMQPEDTATYFCKQVYDVPFT

SEQ ID NO: 69 - protein, 108 aa, Artificial Sequence
  Description of Artificial Sequence: Synthetic polypeptide
  Symphogen Ab 15 Variable heavy (vh) domain
QVTLKESGAELVRPGASVKLSCKASGYSFTSYWMNWVKQRPGQGLEWIGMIHPSDSETRLNQKFKDKATLTVDKSSSTAYMQLSSPTSEDSAVYYCARWGDHDDAMDF

SEQ ID NO: 70 - protein, 97 aa, Artificial Sequence
  Description of Artificial Sequence: Synthetic polypeptide
  Symphogen Ab 15 Variable light (vl) domain
DIVLTQSPASLSASVGESVTITCRPSENIYGYFAWYQQRQGKSPQLLVYNAKTLAEGVPSRFSGSGSGTHFSLKINSLQPEDFGTYYCQHHYGTPFT

SEQ ID NO: 71 - protein, 110 aa, Artificial Sequence
  Description of Artificial Sequence: Synthetic polypeptide
  Symphogen Ab 16 Variable heavy (vh) domain
EVKLVESGPGLVQPSQSLSITCTVSGFSLTNYDVHWVRQSPGKGLEWLGVIWSGGNTDYNAAFISRLSITKDNSKSQVFFKMNSLQTKDTAIYSCARNHGDGYFNWYFDV

SEQ ID NO: 72 - protein, 96 aa, Artificial Sequence
  Description of Artificial Sequence: Synthetic polypeptide
  Symphogen Ab 16 Variable light (vl) domain
DIVMTQSPSSLSESLGGKVTITCKASQDINNYIAWYQHKPGKGPRLLIHYTSTLLPGIPSRFSGSGSGTDYSFSISNLEPEDIATYYCLQYDNLWT

SEQ ID NO: 73 - protein, 110 aa, Artificial Sequence
  Description of Artificial Sequence: Synthetic polypeptide
  Symphogen Ab 17 Variable heavy (vh) domain
EVQLVESGPGLVQPSQSLSITCTVSGFSLTNYDVHWVRQSPGKGLEWLGVIWNYGNTDYNAAFISRLSIRKDSSKSQVFFTMSSLQTPDTAIYYCARNHGDGYYNWYFDV

SEQ ID NO: 74 - protein, 96 aa, Artificial Sequence
  Description of Artificial Sequence: Synthetic polypeptide
  Symphogen Ab 17 Variable light (vl) domain
NIVLTQSPSSLSESLGGKVTITCKASQDINKYIAWYQYKPGKGPRLLIHYTSTLQPGIPSRFSGSGSGRDYSFSISNLEPEDIATYYCLQYDNLWT

SEQ ID NO: 75 - protein, 113 aa, Artificial Sequence
  Description of Artificial Sequence: Synthetic polypeptide
  Symphogen Ab 18 Variable heavy (vh) domain
QVQLKESGGGLVQPGGSLKLSCAASGFTFSNYGMSWVRQIPDKRLELVAAINSNGDITYDPDSVKGRFTISRDNANNSLFLQMRSLKSEDTAMYYCARGTAWFTYWGQGTLVT

SEQ ID NO: 76 - protein, 97 aa, Artificial Sequence
  Description of Artificial Sequence: Synthetic polypeptide
  Symphogen Ab 18 Variable light (vl) domain
DIVLTQSPASLSASVGETVIITCRASENIYSYLVWYQQKQGKSPQLLVYNAKTLAEGVPSRFSGSGSGTQFSLKINSLQSEDFGSYSCQHHYGYPYT

SEQ ID NO: 77 - protein, 108 aa, Artificial Sequence
  Description of Artificial Sequence: Synthetic polypeptide
  Symphogen Ab 19 Variable heavy (vh) domain
EVQLQESGPELVKPGASMKISCKASGYSFTGYTMNWVKQSHGENLEWIGLINPYNGGTRYNQKFKDKATLTVNKSSSTAYMELLSLTSEDSAVYYCARDGDDGWDIDV

SEQ ID NO: 78 - protein, 97 aa, Artificial Sequence
  Description of Artificial Sequence: Synthetic polypeptide
  Symphogen Ab 19 Variable light (vl) domain
NIVLTQSTSSLSASLGDRVTISCSASQGIRNYLNWYQQKPDGTVKLLIYHTSTLHSGVPSRFSGSGSGTDYSLTISNLEPEDIATYYCQQYSNLPLT

SEQ ID NO: 79 - protein, 107 aa, Artificial Sequence
  Description of Artificial Sequence: Synthetic polypeptide
  Symphogen Ab 20 Variable heavy (vh) domain
EVKLVESGPELKKPGETVKISCKASGYIFANYGMNWVKQAPGKGLKWMGWINTYTGEPTYADDFKGRFAFSLETSASTARLQINNLKKEDTATYFCARRGTYWHFDV

SEQ ID NO: 80 - protein, 97 aa, Artificial Sequence
  Description of Artificial Sequence: Synthetic polypeptide
  Symphogen Ab 20 Variable light (vl) domain
NIVMTQSHRFMSTSVGDRVSITCKASQDVRTDVAWFQQKPGQSPKLLIYSASFRYTGVPDRFTGSGSGTDFTLTISSVQAEDLAVYYCQQHYTSPWT

SEQ ID NO: 81 - protein, 107 aa, Artificial Sequence
  Description of Artificial Sequence: Synthetic polypeptide
  Symphogen Ab 21 Variable heavy (vh) domain
EVQLQQSGPELKKPGETVKISCKASGYNFTNYGMNWVKQAPGKGLKWMGWINTYTGEPTYADDFKGRFAFSLETSASTVYLRINNLKNEDSSTFFCARRGSYWHFDV

SEQ ID NO: 82 - protein, 97 aa, Artificial Sequence
  Description of Artificial Sequence: Synthetic polypeptide
  Symphogen Ab 21 Variable light (vl) domain
HIVLTQSHKFMSTSVGDRVSITCKASQDVITAVTWSQQKPGQSPKLLIYSASYRYTGVPDRFTGSGSGTDFTFTISSVQAEDLAVYYCQQHYSTPWT

SEQ ID NO: 83 - protein, 106 aa, Artificial Sequence
  Description of Artificial Sequence: Synthetic polypeptide
  Symphogen Ab 22 Variable heavy (vh) domain
QVQLQESGPELKKPGETVKISCKASGYTFTNYGMNWVKQAPGKGLKWMGWINTYTGEPTYADDFKGRFALSLEASVSTAYLQINNLKNEDTATYFCARRSTLVFDY

SEQ ID NO: 84 - protein, 97 aa, Artificial Sequence
  Description of Artificial Sequence: Synthetic polypeptide
  Symphogen Ab 22 Variable light (vl) domain
NIVMTQSPAILSVSPGERVSFSCRASQSIGTSINWYQQRTNASPRLLIKSASESISGIPSRFSGSGSGTDFTLNIKNVESEDIADYYCQQSNRWPLT

SEQ ID NO: 85 - protein, 106 aa, Artificial Sequence
  Description of Artificial Sequence: Synthetic polypeptide
  Symphogen Ab 23 Variable heavy (vh) domain
EVQLQQSGPELVKPGTSVKISCKASGYTFTDYYINWVKQKPGQGLEWIGWIYPGGGNTRYIERFKGKATLTVDTSSSTAYMQLSSLTSEDTAVYFCARNGYWYFDV

SEQ ID NO: 86 - protein, 100 aa, Artificial Sequence
  Description of Artificial Sequence: Synthetic polypeptide
  Symphogen Ab 23 Variable light (vl) domain
DIVLTQSPSSLTVTAGEKVTMSCKSSQSLLNQKNYLTWYQQKTGQPPKLLIYWASTRESGVPDRFTGSGSGTDFTLTISSVQAEDLAVYYCQNDYDYPYT

SEQ ID NO: 87 - protein, 106 aa, Artificial Sequence
  Description of Artificial Sequence: Synthetic polypeptide
  Symphogen Ab 24 Variable heavy (vh) domain
EVKLVESGPELVKPGTSVKISCKASGYTFTDYYINWVKQRPGQGLEWIGWIYPGGGNTRYIERFKGKATLTVDTSSSTAYMQLSSLTSEDTAVYFCARNGYWYFDV

SEQ ID NO: 88 - protein, 98 aa, Artificial Sequence
  Description of Artificial Sequence: Synthetic polypeptide
  Symphogen Ab 24 Variable light (vl) domain
DIVMTQSPAIMSASLGERVTMTCTASSSVSSSYLHWYQQKPGSSPKLWIYSTSNLASGVPARFSGSGSGTSYSLTISSMEAEDAATYYCHQYHRSPLT

SEQ ID NO: 89 - protein, 110 aa, Artificial Sequence
  Description of Artificial Sequence: Synthetic polypeptide
  Symphogen Ab 25 Variable heavy (vh) domain
EVKLVESGPELVKPGASVRISCKSSGNTFTNFYLHWMKQRPGQGLEWIGCIYPGNVKTKYSARFKGKAILTADKSSSTVFMQLSNLTSEDSAVYFCAKEGDYDGTAYFDY

SEQ ID NO: 90 - protein, 97 aa, Artificial Sequence
  Description of Artificial Sequence: Synthetic polypeptide
  Symphogen Ab 25 Variable light (vl) domain
NIVLTQSPASLAASVGETVTITCRVSENIYYNLAWYQQKQGKSPQLLIYNANSLEDGVPSRFSGSGSGTQYSMKINSMQPEDTATYFCQQTFDVPWT

SEQ ID NO: 91 - protein, 106 aa, Artificial Sequence
  Description of Artificial Sequence: Synthetic polypeptide
  Symphogen Ab 26 Variable heavy (vh) domain
KVQLQQSGPELKKPGETVKISCKASGYTFTNYGMNWVKQAPGKGLKWMGWINTYTGEPTYADDFKGRFAFSLETSARTAYLQINNLKNEDSATYFCARRRDGNFDY

SEQ ID NO: 92 - protein, 97 aa, Artificial Sequence
  Description of Artificial Sequence: Synthetic polypeptide
  Symphogen Ab 26 Variable light (vl) domain
HIVLTQSPAILSVSPGERVSFSCRASQTIGTSIHWYQQRTNGSPRLLIKNASESISGIPSRFSGSGSGTDFTLSINSVESEDIADYYCQQSNSWPLT

SEQ ID NO: 93 - protein, 104 aa, Artificial Sequence
  Description of Artificial Sequence: Synthetic polypeptide
  Symphogen Ab 27 Variable heavy (vh) domain
EVQLVESGGGLVKPGGSLKLSCAASEFTFSNYAMSWVRQTPEKGLEWVATISSGGSYTYYSDSVKGRFTISRDNVKNTLYLQMSSLRSEDTAMYYCVRHGYFDV

SEQ ID NO: 94 - protein, 103 aa, Artificial Sequence
  Description of Artificial Sequence: Synthetic polypeptide
  Symphogen Ab 27 Variable light (vl) domain
NIVMTQSPSSLAVSVGEKVTMSCKSSQSLLYSSDQKNYLAWYQLKPGQSPKLLIYWASTRESGVPDRFTGSGSGTDFTLTISSVKAEDLAVYYCQQYYNYPLT

SEQ ID NO: 95 - protein, 103 aa, Artificial Sequence
  Description of Artificial Sequence: Synthetic polypeptide
  Symphogen Ab 28 Variable heavy (vh) domain
EVQLQQPEAELVRPGASVKLSCKASGYTFTSYRMNWVKQRPEEGLEWIGRIDPYDSGTHYNQKFKDKAILTVDKSSSIAYMQLSSLTSEDSAVYYCAFYDGAY

SEQ ID NO: 96 - protein, 96 aa, Artificial Sequence
  Description of Artificial Sequence: Synthetic polypeptide
  Symphogen Ab 28 Variable light (vl) domain
DIVLTQSPAIMSASPGEKVTMTCSANSSVSYMLWYQQKSGTSPKRWIYDTSKLSSGVPARFSGSGSGTSYSLTISSMEAEDAATYYCQQWSSNPFT

SEQ ID NO: 97 - protein, 103 aa, Artificial Sequence
  Description of Artificial Sequence: Synthetic polypeptide
  Symphogen Ab 29 Variable heavy (vh) domain
QVQLKESGADLVKPGASVKLSCTASGFNIKDTYMNWVKERPEQGLEWIGRIDPANGNTKYDPKFQGKATITADTSSNTGYLQLSSLTSEDTAVYYCASYDPDY

SEQ ID NO: 98 - protein, 97 aa, Artificial Sequence
  Description of Artificial Sequence: Synthetic polypeptide
  Symphogen Ab 29 Variable light (vl) domain
DIVLTQSPASLAASVGETVTITCRASENIYYNLAWYQQKQGKSPQLLIYNANSLEGGVPSRFSGSGSGTQYSMKINSMQPEDTATYFCKQAYDVPWT

SEQ ID NO: 99 - protein, 108 aa, Artificial Sequence
  Description of Artificial Sequence: Synthetic polypeptide
  Symphogen Ab 30 Variable heavy (vh) domain
EVQLVESGPELVRPGASMRISCKASGYSFTDYTMNWVKQSHGKNLEWIGLINPYNGGTRNNQKFKGKATLTVDKSSSTAYMELLSLTSEDSAVYYCARDTTATYYFDY

SEQ ID NO: 100 - protein, 96 aa, Artificial Sequence
  Description of Artificial Sequence: Synthetic polypeptide
  Symphogen Ab 30 Variable light (vl) domain
EIVLTQSPAIMSASPGEKVTMTCSASSSLSYMYWYQQKPGSSPRLLIYDTSNLASGVPFRFSGSGSGTSYSLTISRMEAEDAATYYCQQWSSFPPT

SEQ ID NO: 101 - protein, 106 aa, Artificial Sequence
  Description of Artificial Sequence: Synthetic polypeptide
  Symphogen Ab 31 Variable heavy (vh) domain
EVQLKESGPELKKPGETVKISCMTSGYMFTNHGMNWVKQAPGKGLKWMGWINTYTGEPTYGDGFKGRFVFSLETSASTAYLQINNLKNEDTATYFCARRVATYFDV

SEQ ID NO: 102 - protein, 97 aa, Artificial Sequence
  Description of Artificial Sequence: Synthetic polypeptide
  Symphogen Ab 31 Variable light (vl) domain
NIVLTQSPAILSVSPGERVSFSCRASQRIGTSMNWYQQRTNGSPRLLIKSASESISGIPSRFSGSGSGTDFTLSINSVESDDVADYYCQQSNSWPLT

SEQ ID NO: 103 - protein, 106 aa, Artificial Sequence
  Description of Artificial Sequence: Synthetic polypeptide
  Symphogen Ab 32 Variable heavy (vh) domain
EVKLVESGPELKKPGETVKISCKASGYMFTNYGMNWVKQAPGKGLKWMGWINTYTGEPTYVEDFKGRFAFSLETSANTAYLQINNLKNEDTATYFCTRRSHITLDY

SEQ ID NO: 104 - protein, 97 aa, Artificial Sequence
  Description of Artificial Sequence: Synthetic polypeptide
  Symphogen Ab 32 Variable light (vl) domain
DIVLTQSPVILSVSPGERVSLSCRASQSIGTSINWYQQRTDGSPRLLIKSASESMSGIPSRFSGSGSGTDFTLSITSVESEDIADYYCQQSNSWPLT

SEQ ID NO: 105 - protein, 106 aa, Artificial Sequence
  Description of Artificial Sequence: Synthetic polypeptide
  Symphogen Ab 33 Variable heavy (vh) domain
QVTLKESGPELKKPGETVKISCRASGYIFTNYGMNWVKQAPGKGLKWMGWINTYTGEPTYADDFKGRFAFSLETSASTAHLQINNLKNEDTAIYFCARRRTTAFDY

SEQ ID NO: 106 - protein, 97 aa, Artificial Sequence
  Description of Artificial Sequence: Synthetic polypeptide
  Symphogen Ab 33 Variable light (vl) domain
NIVLTQSPAILSVSPGERVSFSCRASQNIGTSIHWYQQRTNGSPRFLVKDASESISGIPSRFSGSGSGTDFTLTINNVESEDIADYYCQQSDSWPLT

SEQ ID NO: 107 - protein, 109 aa, Artificial Sequence
  Description of Artificial Sequence: Synthetic polypeptide
  Symphogen Ab 34 Variable heavy (vh) domain
EVKLVESGAELVRSGASVKLSCAASGFNIKDYYIHWVKQRPEQGLEWIGWIDPENGRTEYAPKFQGKATMTADTSSNTAYLQLSSLTSEDTAVYYCNNGNYVRHYYFDY

SEQ ID NO: 108 - protein, 96 aa, Artificial Sequence
  Description of Artificial Sequence: Synthetic polypeptide
  Symphogen Ab 34 Variable light (vl) domain
DVVLTQSPAILSASPGEKVTMTCRAISSVSYMHWYQQKPGSSPKPWIYATSNLASGVPARFSGSGSGTSYSLTISRVEAEDAATYYCQQWSSNPRT

SEQ ID NO: 109 - protein, 106 aa, Artificial Sequence
  Description of Artificial Sequence: Synthetic polypeptide
  Symphogen Ab 35 Variable heavy (vh) domain
QVQLQQPGPELKKPGETVKISCKASGYTFINYGMNWVKQAPGKGLKWMGWINTYTGEPTYADDFKGRFAFSLETSASTAYLQINNLEHEDMAVYFCTRRREITFDY

SEQ ID NO: 110 - protein, 97 aa, Artificial Sequence
  Description of Artificial Sequence: Synthetic polypeptide
  Symphogen Ab 35 Variable light (vl) domain
HIVLTQSPAILSVSPGERVSFSCRASQTIATSINWYQQRTNGSPRLLIKNASESISGIPSRFSGSGSGTDFTLTINSVESEDIADYYCQQSNSWPLT

SEQ ID NO: 111 - protein, 105 aa, Artificial Sequence
  Description of Artificial Sequence: Synthetic polypeptide
  Symphogen Ab 36 Variable heavy (vh) domain
QVQLQQPGAELARPGASVMLSCKASGYTFTDYFINWVKQRTGQGLDWIGEIYPGSSNTYYNEKFKGKATLTADESSSTAYMRLSSLTSEDSAVFCARSGISPFTY

SEQ ID NO: 112 - protein, 102 aa, Artificial Sequence
  Description of Artificial Sequence: Synthetic polypeptide
  Symphogen Ab 36 Variable light (vl) domain
MFVMTQTPLSLPVSLGDQASISCRSSQSLVHSNGNTYLHWYLQKPGQSPKLLIYKVSNRFSGVPDRFSGSGSGTDFTLKISRVEAEDLGVYYCWQNTHFPQT

SEQ ID NO: 113 - protein, 105 aa, Artificial Sequence
  Description of Artificial Sequence: Synthetic polypeptide
  Symphogen Ab 37 Variable heavy (vh) domain
QVQLKESGADLVKPGASVKMSCKTSGYIFTGYNIHWVKQTPGQGLVWIGAVYPGNGDTSYNQNFKAKATLTADISSTTAYMQLSSLTSEDSAIYYCAKYDRGFAS

SEQ ID NO: 114 - protein, 101 aa, Artificial Sequence
  Description of Artificial Sequence: Synthetic polypeptide
  Symphogen Ab 37 Variable light (vl) domain
NIVLTQSPASLAVSLGQRATISCRVNESVEYSGTSLMQWYQQKPGQPPKLLISAASNVESGVPARFSGRGSGTDFSLNIHPVEEDDIAMYFCQQSRQVPLT

SEQ ID NO: 115 - protein, 119 aa, Artificial Sequence
  Description of Artificial Sequence: Synthetic polypeptide
  mAb A[PD-1] Variable heavy (vh) domain
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSS

SEQ ID NO: 116 - protein, 6 aa, Artificial Sequence
  Description of Artificial Sequence: Synthetic peptide
  mAb A[PD-1] vhCDR1
SDYAWN

SEQ ID NO: 117 - protein, 16 aa, Artificial Sequence
  Description of Artificial Sequence: Synthetic peptide
  mAb A[PD-1] vhCDR2
YISYSGYTTYNPSLKS

SEQ ID NO: 118 - protein, 10 aa, Artificial Sequence
  Description of Artificial Sequence: Synthetic peptide
  mAb A[PD-1] vhCDR3
DLDYGPWFAY

SEQ ID NO: 119 - protein, 107 aa, Artificial Sequence
  Description of Artificial Sequence: Synthetic polypeptide
  mAb A[PD-1] Variable light (vl) domain
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIK

SEQ ID NO: 120 - protein, 11 aa, Artificial Sequence
  Description of Artificial Sequence: Synthetic peptide
  mAb A[PD-1] vlCDR1
RASENIHNYLA

SEQ ID NO: 121 - protein, 7 aa, Artificial Sequence
  Description of Artificial Sequence: Synthetic peptide
  mAb A[PD-1] vlCDR2
NVKTLAD

SEQ ID NO: 122 - protein, 9 aa, Artificial Sequence
  Description of Artificial Sequence: Synthetic peptide
  mAb A[PD-1] vlCDR3
QHFWSSPWT

SEQ ID NO: 123 - protein, 117 aa, Artificial Sequence
  Description of Artificial Sequence: Synthetic polypeptide
  mAb B[PD-1] Variable heavy (vh) domain
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSS

SEQ ID NO: 124 - protein, 5 aa, Artificial Sequence
  Description of Artificial Sequence: Synthetic peptide
  mAb B[PD-1] vhCDR1
NFYIH

SEQ ID NO: 125 - protein, 17 aa, Artificial Sequence
  Description of Artificial Sequence: Synthetic peptide
  mAb B[PD-1] vhCDR2
SIYPNYGDTAYNQKFQG

SEQ ID NO: 126 - protein, 8 aa, Artificial Sequence
  Description of Artificial Sequence: Synthetic peptide
  mAb B[PD-1] vhCDR3
GYSYAMDY

SEQ ID NO: 127 - protein, 107 aa, Artificial Sequence
  Description of Artificial Sequence: Synthetic polypeptide
  mAb B[PD-1] Variable light (vl) domain
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIK

SEQ ID NO: 128 - protein, 11 aa, Artificial Sequence
  Description of Artificial Sequence: Synthetic peptide
  mAb B[PD-1] vlCDR1
RASQGISGDLN

SEQ ID NO: 129 - protein, 7 aa, Artificial Sequence
  Description of Artificial Sequence: Synthetic peptide
  mAb B[PD-1] vlCDR2
HTSSLHS

SEQ ID NO: 130 - protein, 9 aa, Artificial Sequence
  Description of Artificial Sequence: Synthetic peptide
  mAb B[PD-1] vlCDR3
QYYSKDLLT

SEQ ID NO: 131 - protein, 120 aa, Artificial Sequence [sequence omitted]

SEQ ID NO: 132 - protein, 5 aa, Artificial Sequence
  Description of Artificial Sequence: Synthetic peptide
  pembrolizumab[PD-1] vhCDR1
NYYMY

SEQ ID NO: 133 - protein, 17 aa, Artificial Sequence
  Description of Artificial Sequence: Synthetic peptide
  pembrolizumab[PD-1] vhCDR2
GINPSNGGTNFNEKFKN

SEQ ID NO: 134 - protein, 11 aa, Artificial Sequence
  Description of Artificial Sequence: Synthetic peptide
  pembrolizumab[PD-1] vhCDR3
RDYRFDMGFDY

SEQ ID NO: 135 - protein, 111 aa, Artificial Sequence [sequence omitted]

SEQ ID NO: 136 - protein, 15 aa, Artificial Sequence
  Description of Artificial Sequence: Synthetic peptide
  pembrolizumab[PD-1] vlCDR1
RASKGVSTSGYSYLH

SEQ ID NO: 137 - protein, 7 aa, Artificial Sequence
  Description of Artificial Sequence: Synthetic peptide
  pembrolizumab[PD-1] vlCDR2
LASYLES

SEQ ID NO: 138 - protein, 9 aa, Artificial Sequence
  Description of Artificial Sequence: Synthetic peptide
  pembrolizumab[PD-1] vlCDR3
QHSRDLPLT

SEQ ID NO: 139 - protein, 113 aa, Artificial Sequence [sequence omitted]

SEQ ID NO: 140 - protein, 5 aa, Artificial Sequence
  Description of Artificial Sequence: Synthetic peptide
  nivolumab[PD-1] vhCDR1
NSGMH

SEQ ID NO: 141 - protein, 17 aa, Artificial Sequence
  Description of Artificial Sequence: Synthetic peptide
  nivolumab[PD-1] vhCDR2
VIWYDGSKRYYADSVKG

SEQ ID NO: 142 - protein, 4 aa, Artificial Sequence
  Description of Artificial Sequence: Synthetic peptide
  nivolumab[PD-1] vhCDR3
NDDY

SEQ ID NO: 143 - protein, 107 aa, Artificial Sequence [sequence omitted]

SEQ ID NO: 144 - protein, 11 aa, Artificial Sequence
  Description of Artificial Sequence: Synthetic peptide
  nivolumab[PD-1] vlCDR1
RASQSVSSYLA

SEQ ID NO: 145 - protein, 7 aa, Artificial Sequence
  Description of Artificial Sequence: Synthetic peptide
  nivolumab[PD-1] vlCDR2
DASNRAT

SEQ ID NO: 146 - protein, 9 aa, Artificial Sequence
  Description of Artificial Sequence: Synthetic peptide
  nivolumab[PD-1] vlCDR3
QQSSNWPRT

SEQ ID NO: 147 - protein, 117 aa, Artificial Sequence
  Description of Artificial Sequence: Synthetic polypeptide
  pidilizumab[PD-1] Variable heavy (vh) domain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 148 - protein, 5 aa, Artificial Sequence
  Description of Artificial Sequence: Synthetic peptide
  pidilizumab[PD-1] vhCDR1
NYGMN

SEQ ID NO: 149 - protein, 17 aa, Artificial Sequence
  Description of Artificial Sequence: Synthetic peptide
  pidilizumab[PD-1] vhCDR2
WINTDSGESTYAEEFKG

SEQ ID NO: 150 - protein, 8 aa, Artificial Sequence
  Description of Artificial Sequence: Synthetic peptide
  pidilizumab[PD-1] vhCDR3
VGYDALDY

SEQ ID NO: 151 - protein, 106 aa, Artificial Sequence
  Description of Artificial Sequence: Synthetic polypeptide
  pidilizumab[PD-1] Variable light (vl) domain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 152 - protein, 10 aa, Artificial Sequence
  Description of Artificial Sequence: Synthetic peptide
  pidilizumab[PD-1] vlCDR1
SARSSVSYMH

SEQ ID NO: 153 - protein, 7 aa, Artificial Sequence
  Description of Artificial Sequence: Synthetic peptide
  pidilizumab[PD-1] vlCDR2
RTSNLAS

SEQ ID NO: 154 - protein, 9 aa, Artificial Sequence
  Description of Artificial Sequence: Synthetic peptide
  pidilizumab[PD-1] vlCDR3
QQRSSFPLT

SEQ ID NO: 155 - protein, 120 aa, Artificial Sequence [sequence omitted]

SEQ ID NO: 156 - protein, 5 aa, Artificial Sequence
  Description of Artificial Sequence: Synthetic peptide
  MK-3475[PD-1] vhCDR1
NYYMY

SEQ ID NO: 157 - protein, 17 aa, Artificial Sequence
  Description of Artificial Sequence: Synthetic peptide
  MK-3475[PD-1] vhCDR2
GINPSNGGTNFNEKFKN

SEQ ID NO: 158 - protein, 11 aa, Artificial Sequence
  Description of Artificial Sequence: Synthetic peptide
  MK-3475[PD-1] vhCDR3
RDYRFDMGFDY

SEQ ID NO: 159 - protein, 111 aa, Artificial Sequence [sequence omitted]

SEQ ID NO: 160 - protein, 15 aa, Artificial Sequence
  Description of Artificial Sequence: Synthetic peptide
  MK-3475[PD-1] vlCDR1
RASKGVSTSGYSYLH

SEQ ID NO: 161 - protein, 7 aa, Artificial Sequence
  Description of Artificial Sequence: Synthetic peptide
  MK-3475[PD-1] vlCDR2
LASYLES

SEQ ID NO: 162 - protein, 9 aa, Artificial Sequence
  Description of Artificial Sequence: Synthetic peptide
  MK-3475[PD-1] vlCDR3
QHSRDLPLT

SEQ ID NO: 163 - protein, 117 aa, Artificial Sequence
  Description of Artificial Sequence: Synthetic polypeptide
  BAP049 Clone E[PD-1] Variable heavy (vh) domain
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 164 - protein, 5 aa, Artificial Sequence
  Description of Artificial Sequence: Synthetic peptide
  BAP049 Clone E[PD-1] vhCDR1
TYWMH

SEQ ID NO: 165 - protein, 17 aa, Artificial Sequence
  Description of Artificial Sequence: Synthetic peptide
  BAP049 Clone E[PD-1] vhCDR2
NIYPGTGGSNFDEKFKN

SEQ ID NO: 166 - protein, 8 aa, Artificial Sequence
  Description of Artificial Sequence: Synthetic peptide
  BAP049 Clone E[PD-1] vhCDR3
WTTGTGAY

SEQ ID NO: 167 - protein, 113 aa, Artificial Sequence
  Description of Artificial Sequence: Synthetic polypeptide
  BAP049 Clone E[PD-1] Variable light (vl) domain
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 168 - protein, 17 aa, Artificial Sequence
  Description of Artificial Sequence: Synthetic peptide
  BAP049 Clone E[PD-1] vlCDR1
KSSQSLLDSGNQKNFLT

SEQ ID NO: 169 - protein, 7 aa, Artificial Sequence
  Description of Artificial Sequence: Synthetic peptide
  BAP049 Clone E[PD-1] vlCDR2
WASTRES

SEQ ID NO: 170 - protein, 9 aa, Artificial Sequence
  Description of Artificial Sequence: Synthetic peptide
  BAP049 Clone E[PD-1] vlCDR3
QNDYSYPYT

SEQ ID NO: 171 - protein, 117 aa, Artificial Sequence; identical to SEQ ID NO: 163
  Description of Artificial Sequence: Synthetic polypeptide
  BAP049 Clone B[PD-1] Variable heavy (vh) domain

SEQ ID NO: 172 - protein, 5 aa, Artificial Sequence
  Description of Artificial Sequence: Synthetic peptide
  BAP049 Clone B[PD-1] vhCDR1
TYWMH

SEQ ID NO: 173 - protein, 17 aa, Artificial Sequence
  Description of Artificial Sequence: Synthetic peptide
  BAP049 Clone B[PD-1] vhCDR2
NIYPGTGGSNFDEKFKN

SEQ ID NO: 174 - protein, 8 aa, Artificial Sequence
  Description of Artificial Sequence: Synthetic peptide
  BAP049 Clone B[PD-1] vhCDR3
WTTGTGAY

SEQ ID NO: 175 - protein, 113 aa, Artificial Sequence
  Description of Artificial Sequence: Synthetic polypeptide
  BAP049 Clone B[PD-1] Variable light (vl) domain
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 176 - protein, 17 aa, Artificial Sequence
  Description of Artificial Sequence: Synthetic peptide
  BAP049 Clone B[PD-1] vlCDR1
KSSQSLLDSGNQKNFLT

SEQ ID NO: 177 - protein, 7 aa, Artificial Sequence
  Description of Artificial Sequence: Synthetic peptide
  BAP049 Clone B[PD-1] vlCDR2
WASTRES

SEQ ID NO: 178 - protein, 9 aa, Artificial Sequence
  Description of Artificial Sequence: Synthetic peptide
  BAP049 Clone B[PD-1] vlCDR3
QNDYSYPYT

SEQ ID NO: 179 - protein, 117 aa, Artificial Sequence [sequence omitted]

SEQ ID NO: 180 - protein, 5 aa, Artificial Sequence
  Description of Artificial Sequence: Synthetic peptide
  H7798N[PD-1] vhCDR1
NFGMT

SEQ ID NO: 181 - protein, 17 aa, Artificial Sequence
  Description of Artificial Sequence: Synthetic peptide
  H7798N[PD-1] vhCDR2
GISGGGRDTYFADSVKG

SEQ ID NO: 182 - protein, 8 aa, Artificial Sequence
  Description of Artificial Sequence: Synthetic peptide
  H7798N[PD-1] vhCDR3
WGNIYFDY

SEQ ID NO: 183 - protein, 107 aa, Artificial Sequence [sequence omitted]

SEQ ID NO: 184 - protein, 11 aa, Artificial Sequence
  Description of Artificial Sequence: Synthetic peptide
  H7798N[PD-1] vlCDR1
RASLSINTFLN

SEQ ID NO: 185 - protein, 7 aa, Artificial Sequence
  Description of Artificial Sequence: Synthetic peptide
  H7798N[PD-1] vlCDR2
AASSLHG

SEQ ID NO: 186 - protein, 9 aa, Artificial Sequence
  Description of Artificial Sequence: Synthetic peptide
  H7798N[PD-1] vlCDR3
QQSSNTPFT

SEQ ID NO: 187 - protein, 122 aa, Artificial Sequence
  Description of Artificial Sequence: Synthetic polypeptide
  h1H3 Var 6[PD-1] Variable heavy (vh) domain
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 188 - protein, 5 aa, Artificial Sequence
  Description of Artificial Sequence: Synthetic peptide
  h1H3 Var 6[PD-1] vhCDR1
DYGMH

SEQ ID NO: 189 - protein, 17 aa, Artificial Sequence
  Description of Artificial Sequence: Synthetic peptide
  h1H3 Var 6[PD-1] vhCDR2
YISSGSYTIYYADSVKG

SEQ ID NO: 190 - protein, 13 aa, Artificial Sequence
  Description of Artificial Sequence: Synthetic peptide
  h1H3 Var 6[PD-1] vhCDR3
RGYGSFYEYYFDY

SEQ ID NO: 191 - protein, 106 aa, Artificial Sequence
  Description of Artificial Sequence: Synthetic polypeptide
  h1H3 Var 6[PD-1] Variable light (vl) domain
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 192 - protein, 10 aa, Artificial Sequence
  Description of Artificial Sequence: Synthetic peptide
  h1H3 Var 6[PD-1] vlCDR1
SASSSVSYMY

SEQ ID NO: 193 - protein, 7 aa, Artificial Sequence
  Description of Artificial Sequence: Synthetic peptide
  h1H3 Var 6[PD-1] vlCDR2
LTSNRAT

SEQ ID NO: 194 - protein, 9 aa, Artificial Sequence
  Description of Artificial Sequence: Synthetic peptide
  h1H3 Var 6[PD-1] vlCDR3
QQWSSNPFT

SEQ ID NO: 195 - protein, 116 aa, Artificial Sequence
  Description of Artificial Sequence: Synthetic polypeptide
  APE2058[PD-1] Variable heavy (vh) domain
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 196 - protein, 5 aa, Artificial Sequence
  Description of Artificial Sequence: Synthetic peptide
  APE2058[PD-1] vhCDR1
SYDMS

SEQ ID NO: 197 - protein, 17 aa, Artificial Sequence
  Description of Artificial Sequence: Synthetic peptide
  APE2058[PD-1] vhCDR2
TISGGGSYTYYQDSVKG

SEQ ID NO: 198 - protein, 7 aa, Artificial Sequence
  Description of Artificial Sequence: Synthetic peptide
  APE2058[PD-1] vhCDR3
PYYAMDY

SEQ ID NO: 199 - protein, 107 aa, Artificial Sequence
  Description of Artificial Sequence: Synthetic polypeptide
  APE2058[PD-1] Variable light (vl) domain
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 200 - protein, 11 aa, Artificial Sequence
  Description of Artificial Sequence: Synthetic peptide
  APE2058[PD-1] vlCDR1
KASQDVGTAVA

SEQ ID NO: 201 - protein, 7 aa, Artificial Sequence
  Description of Artificial Sequence: Synthetic peptide
  APE2058[PD-1] vlCDR2
WASTLHT

SEQ ID NO: 202 - protein, 9 aa, Artificial Sequence
  Description of Artificial Sequence: Synthetic peptide
  APE2058[PD-1] vlCDR3
QHYSSYPWT

SEQ ID NO: 203 - protein, 116 aa, Artificial Sequence
  Description of Artificial Sequence: Synthetic polypeptide
  H005-1[PD-1] Variable heavy (vh) domain
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 204 - protein, 5 aa, Artificial Sequence
  Description of Artificial Sequence: Synthetic peptide
  H005-1[PD-1] vhCDR1
SYMMS

SEQ ID NO: 205 - protein, 17 aa, Artificial Sequence
  Description of Artificial Sequence: Synthetic peptide
  H005-1[PD-1] vhCDR2
TISGGGANTYYPDSVKG

SEQ ID NO: 206 - protein, 7 aa, Artificial Sequence
  Description of Artificial Sequence: Synthetic peptide
  H005-1[PD-1] vhCDR3
QLYYFDY

SEQ ID NO: 207 - protein, 107 aa, Artificial Sequence
  Description of Artificial Sequence: Synthetic polypeptide
  H005-1[PD-1] Variable light (vl) domain
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 208 - protein, 11 aa, Artificial Sequence
  Description of Artificial Sequence: Synthetic peptide
  H005-1[PD-1] vlCDR1
LASQTIGTWLT

SEQ ID NO: 209 - protein, 7 aa, Artificial Sequence
  Description of Artificial Sequence: Synthetic peptide
  H005-1[PD-1] vlCDR2
TATSLAD

SEQ ID NO: 210 - protein, 9 aa, Artificial Sequence
  Description of Artificial Sequence: Synthetic peptide
  H005-1[PD-1] vlCDR3
QQVYSIPWT

SEQ ID NO: 211 - protein, 118 aa, Artificial Sequence
  Description of Artificial Sequence: Synthetic polypeptide
  317-4B6[PD-1] Variable heavy (vh) domain
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 212 - protein, 5 aa, Artificial Sequence
  Description of Artificial Sequence: Synthetic peptide
  317-4B6[PD-1] vhCDR1
SYGVH

SEQ ID NO: 213 - protein, 16 aa, Artificial Sequence
  Description of Artificial Sequence: Synthetic peptide
  317-4B6[PD-1] vhCDR2
VIYADGSTNYNPSLKS

SEQ ID NO: 214 - protein, 10 aa, Artificial Sequence
  Description of Artificial Sequence: Synthetic peptide
  317-4B6[PD-1] vhCDR3
AYGNYWYIDV

SEQ ID NO: 215 - protein, 107 aa, Artificial Sequence
  Description of Artificial Sequence: Synthetic polypeptide
  317-4B6[PD-1] Variable light (vl) domain
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 216 - protein, 11 aa, Artificial Sequence
  Description of Artificial Sequence: Synthetic peptide
  317-4B6[PD-1] vlCDR1
KSSESVSNDVA

SEQ ID NO: 217 - protein, 7 aa, Artificial Sequence
  Description of Artificial Sequence: Synthetic peptide
  317-4B6[PD-1] vlCDR2
YAFHRFT

SEQ ID NO: 218 - protein, 9 aa, Artificial Sequence
  Description of Artificial Sequence: Synthetic peptide
  317-4B6[PD-1] vlCDR3
HQAYSSPYT

SEQ ID NO: 219 - protein, 114 aa, Artificial Sequence
  Description of Artificial Sequence: Synthetic polypeptide
  326-4A3[PD-1] Variable heavy (vh) domain
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 220 - protein, 5 aa, Artificial Sequence
  Description of Artificial Sequence: Synthetic peptide
  326-4A3[PD-1] vhCDR1
NYGMN

SEQ ID NO: 221 - protein, 17 aa, Artificial Sequence
  Description of Artificial Sequence: Synthetic peptide
  326-4A3[PD-1] vhCDR2
WINNNNAEPTYAQDFRG

SEQ ID NO: 222 - protein, 5 aa, Artificial Sequence
  Description of Artificial Sequence: Synthetic peptide
  326-4A3[PD-1] vhCDR3
DVMDY

SEQ ID NO: 223 - protein, 110 aa, Artificial Sequence
  Description of Artificial Sequence: Synthetic polypeptide
  326-4A3[PD-1] Variable light (vl) domain
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 224 - protein, 15 aa, Artificial Sequence
  Description of Artificial Sequence: Synthetic peptide
  326-4A3[PD-1] vlCDR1
RASESVDNYGYSFMH

SEQ ID NO: 225 - protein, 7 aa, Artificial Sequence
  Description of Artificial Sequence: Synthetic peptide
  326-4A3[PD-1] vlCDR2
RASNLES

SEQ ID NO: 226 - protein, 8 aa, Artificial Sequence
  Description of Artificial Sequence: Synthetic peptide
  326-4A3[PD-1] vlCDR3
QQSKEYPT

SEQ ID NO: 227 - protein, 119 aa, Artificial Sequence
  Description of Artificial Sequence: Synthetic polypeptide
  hPD-1 mAb 7 (1.2)[PD-1] Variable heavy (vh) domain
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 228 - protein, 5 aa, Artificial Sequence
  Description of Artificial Sequence: Synthetic peptide
  hPD-1 mAb 7 (1.2)[PD-1] vhCDR1
SYWMN

SEQ ID NO: 229 - protein, 17 aa, Artificial Sequence
  Description of Artificial Sequence: Synthetic peptide
  hPD-1 mAb 7 (1.2)[PD-1] vhCDR2
VIHPSDSETWLDQKFKD

SEQ ID NO: 230 - protein, 10 aa, Artificial Sequence
  Description of Artificial Sequence: Synthetic peptide
  hPD-1 mAb 7 (1.2)[PD-1] vhCDR3
EHYGTSPFAY

SEQ ID NO: 231 - protein, 111 aa, Artificial Sequence
  Description of Artificial Sequence: Synthetic polypeptide
  hPD-1 mAb 7 (1.2)[PD-1] Variable light (vl) domain
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 232 - protein, 15 aa, Artificial Sequence
  Description of Artificial Sequence: Synthetic peptide
  hPD-1 mAb 7 (1.2)[PD-1] vlCDR1
RASESVDNYGMSFMN

SEQ ID NO: 233 - protein, 7 aa, Artificial Sequence
  Description of Artificial Sequence: Synthetic peptide
  hPD-1 mAb 7 (1.2)[PD-1] vlCDR2
AASNQGS

SEQ ID NO: 234 - protein, 9 aa, Artificial Sequence
  Description of Artificial Sequence: Synthetic peptide
  hPD-1 mAb 7 (1.2)[PD-1] vlCDR3
QQSKEVPYT

SEQ ID NO: 235 - protein, 125 aa, Artificial Sequence [sequence omitted]

SEQ ID NO: 236 - protein, 5 aa, Artificial Sequence
  Description of Artificial Sequence: Synthetic peptide
  Clone 38[PD-1] vhCDR1
DYEMH

SEQ ID NO: 237 - protein, 17 aa, Artificial Sequence
  Description of Artificial Sequence: Synthetic peptide
  Clone 38[PD-1] vhCDR2
VIESETGGTAYNQKFKG

SEQ ID NO: 238 - protein, 16 aa, Artificial Sequence
  Description of Artificial Sequence: Synthetic peptide
  Clone 38[PD-1] vhCDR3
EGITTVATTYYWYFDV

SEQ ID NO: 239 - protein, 112 aa, Artificial Sequence [sequence omitted]

SEQ ID NO: 240 - protein, 16 aa, Artificial Sequence
  Description of Artificial Sequence: Synthetic peptide
  Clone 38[PD-1] vlCDR1
RSSQSIVHSNGNTYLE

SEQ ID NO: 241 - protein, 7 aa, Artificial Sequence
  Description of Artificial Sequence: Synthetic peptide
  Clone 38[PD-1] vlCDR2
KVSNRFS

SEQ ID NO: 242 - protein, 9 aa, Artificial Sequence
  Description of Artificial Sequence: Synthetic peptide
  Clone 38[PD-1] vlCDR3
FQGSHVPLT

SEQ ID NO: 243 - protein, 125 aa, Artificial Sequence
  Description of Artificial Sequence: Synthetic polypeptide
  Clone 39[PD-1] Variable heavy (vh) domain
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 244 - protein, 5 aa, Artificial Sequence
  Description of Artificial Sequence: Synthetic peptide
  Clone 39[PD-1] vhCDR1
DYEMH

SEQ ID NO: 245 - protein, 17 aa, Artificial Sequence
  Description of Artificial Sequence: Synthetic peptide
  Clone 39[PD-1] vhCDR2
VIESETGGTAYNQKFKG

SEQ ID NO: 246 - protein, 16 aa, Artificial Sequence
  Description of Artificial Sequence: Synthetic peptide
  Clone 39[PD-1] vhCDR3
EGITTVATTYYWYFDV

SEQ ID NO: 247 - protein, 112 aa, Artificial Sequence [sequence omitted]

SEQ ID NO: 248 - protein, 16 aa, Artificial Sequence
  Description of Artificial Sequence: Synthetic peptide
  Clone 39[PD-1] vlCDR1
RSSQSIVHSNGNTYLE

SEQ ID NO: 249 - protein, 7 aa, Artificial Sequence
  Description of Artificial Sequence: Synthetic peptide
  Clone 39[PD-1] vlCDR2
KVSNRFS

SEQ ID NO: 250 - protein, 9 aa, Artificial Sequence
  Description of Artificial Sequence: Synthetic peptide
  Clone 39[PD-1] vlCDR3
FQGSHVPLT

SEQ ID NO: 251 - protein, 125 aa, Artificial Sequence
  Description of Artificial Sequence: Synthetic polypeptide
  Clone 41[PD-1] Variable heavy (vh) domain
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 252 - protein, 5 aa, Artificial Sequence
  Description of Artificial Sequence: Synthetic peptide
  Clone 41[PD-1] vhCDR1
DYEMH

SEQ ID NO: 253 - protein, 17 aa, Artificial Sequence
  Description of Artificial Sequence: Synthetic peptide
  Clone 41[PD-1] vhCDR2
VIESETGGTAYNQKFQG

SEQ ID NO: 254 - protein, 16 aa, Artificial Sequence
  Description of Artificial Sequence: Synthetic peptide
  Clone 41[PD-1] vhCDR3
EGITTVATTYYWYFDV

SEQ ID NO: 255 - protein, 112 aa, Artificial Sequence [sequence omitted]

SEQ ID NO: 256 - protein, 16 aa, Artificial Sequence
  Description of Artificial Sequence: Synthetic peptide
  Clone 41[PD-1] vlCDR1
RSSQSIVHSNGNTYLE

SEQ ID NO: 257 - protein, 7 aa, Artificial Sequence
  Description of Artificial Sequence: Synthetic peptide
  Clone 41[PD-1] vlCDR2
KVSNRFS

SEQ ID NO: 258 - protein, 9 aa, Artificial Sequence
  Description of Artificial Sequence: Synthetic peptide
  Clone 41[PD-1] vlCDR3
FQGSHVPLT

SEQ ID NO: 259 - protein, 125 aa, Artificial Sequence; identical to SEQ ID NO: 243
  Description of Artificial Sequence: Synthetic polypeptide
  Clone 48[PD-1] Variable heavy (vh) domain

SEQ ID NO: 260 - protein, 5 aa, Artificial Sequence
  Description of Artificial Sequence: Synthetic peptide
  Clone 48[PD-1] vhCDR1
DYEMH

SEQ ID NO: 261 - protein, 17 aa, Artificial Sequence
  Description of Artificial Sequence: Synthetic peptide
  Clone 48[PD-1] vhCDR2
VIESETGGTAYNQKFKG

SEQ ID NO: 262 - protein, 16 aa, Artificial Sequence
  Description of Artificial Sequence: Synthetic peptide
  Clone 48[PD-1] vhCDR3
EGITTVATTYYWYFDV

SEQ ID NO: 263 - protein, 112 aa, Artificial Sequence
  Description of Artificial Sequence: Synthetic polypeptide
  Clone 48[PD-1] Variable light (vl) domain
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 264 - protein, 16 aa, Artificial Sequence
  Description of Artificial Sequence: Synthetic peptide
  Clone 48[PD-1] vlCDR1
RSSQSIVHSNGNTYLE

SEQ ID NO: 265 - protein, 7 aa, Artificial Sequence
  Description of Artificial Sequence: Synthetic peptide
  Clone 48[PD-1] vlCDR2
KVSNRFS

SEQ ID NO: 266 - protein, 9 aa, Artificial Sequence
  Description of Artificial Sequence: Synthetic peptide
  Clone 48[PD-1] vlCDR3
FQGSHVPLT

SEQ ID NO: 267 - protein, 128 aa, Artificial Sequence
  Description of Artificial Sequence: Synthetic polypeptide
  PD1-17[PD-1] Variable heavy (vh) domain
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 268 - protein, 12 aa, Artificial Sequence
  Description of Artificial Sequence: Synthetic peptide
  PD1-17[PD-1] vhCDR1
SGGSIRSTRWWS

SEQ ID NO: 269 - protein, 16 aa, Artificial Sequence
  Description of Artificial Sequence: Synthetic peptide
  PD1-17[PD-1] vhCDR2
EIYHSGSTNYNPSLKS

SEQ ID NO: 270 - protein, 13 aa, Artificial Sequence
  Description of Artificial Sequence: Synthetic peptide
  PD1-17[PD-1] vhCDR3
QDYGDSGDWYFDL

SEQ ID NO: 271 - protein, 110 aa, Artificial Sequence
  Description of Artificial Sequence: Synthetic polypeptide
  PD1-17[PD-1] Variable light (vl) domain
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 272 - protein, 13 aa, Artificial Sequence
  Description of Artificial Sequence: Synthetic peptide
  PD1-17[PD-1] vlCDR1
TRSSGSIASNSVQ

SEQ ID NO: 273 - protein, 7 aa, Artificial Sequence
  Description of Artificial Sequence: Synthetic peptide
  PD1-17[PD-1] vlCDR2
EDNQRPS

SEQ ID NO: 274 - protein, 9 aa, Artificial Sequence
  Description of Artificial Sequence: Synthetic peptide
  PD1-17[PD-1] vlCDR3
QSSDSSAVV

SEQ ID NO: 275 - protein, 119 aa, Artificial Sequence
  Description of Artificial Sequence: Synthetic polypeptide
  PD1-28[PD-1] Variable heavy (vh) domain
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 276 - protein, 5 aa, Artificial Sequence
  Description of Artificial Sequence: Synthetic peptide
  PD1-28[PD-1] vhCDR1
SYGIS

SEQ ID NO: 277 - protein, 17 aa, Artificial Sequence
  Description of Artificial Sequence: Synthetic peptide
  PD1-28[PD-1] vhCDR2
WISAYNGNTNYAQKLQG

SEQ ID NO: 278 - protein, 10 aa, Artificial Sequence
  Description of Artificial Sequence: Synthetic peptide
  PD1-28[PD-1] vhCDR3
DADYSSGSGY

SEQ ID NO: 279 - protein, 108 aa, Artificial Sequence
  Description of Artificial Sequence: Synthetic polypeptide
  PD1-28[PD-1] Variable light (vl) domain
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 280 - protein, 11 aa, Artificial Sequence
  Description of Artificial Sequence: Synthetic peptide
  PD1-28[PD-1] vlCDR1
SGDALPKQYAY

SEQ ID NO: 281 - protein, 7 aa, Artificial Sequence
  Description of Artificial Sequence: Synthetic peptide
  PD1-28[PD-1] vlCDR2
KDTERPS

SEQ ID NO: 282 - protein, 11 aa, Artificial Sequence
  Description of Artificial Sequence: Synthetic peptide
  PD1-28[PD-1] vlCDR3
QSADNSITYRV

SEQ ID NO: 283 - protein, 119 aa, Artificial Sequence
  Description of Artificial Sequence: Synthetic polypeptide
  PD1-33[PD-1] Variable heavy (vh) domain
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 284 - protein, 5 aa, Artificial Sequence
  Description of Artificial Sequence: Synthetic peptide
  PD1-33[PD-1] vhCDR1
SYYIH

SEQ ID NO: 285 - protein, 17 aa, Artificial Sequence
  Description of Artificial Sequence: Synthetic peptide
  PD1-33[PD-1] vhCDR2
IINPRGATISYAQKFQG

SEQ ID NO: 286 - protein, 10 aa, Artificial Sequence
  Description of Artificial Sequence: Synthetic peptide
  PD1-33[PD-1] vhCDR3
AGIYGFDFDY

SEQ ID NO: 287 - protein, 111 aa, Artificial Sequence
  Description of Artificial Sequence: Synthetic polypeptide
  PD1-33[PD-1] Variable light (vl) domain
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 288 - protein, 14 aa, Artificial Sequence
  Description of Artificial Sequence: Synthetic peptide
  PD1-33[PD-1] vlCDR1
TGTSNDVGGYNYVS

SEQ ID NO: 289 - protein, 7 aa, Artificial Sequence
  Description of Artificial Sequence: Synthetic peptide
  PD1-33[PD-1] vlCDR2
DVTNRPS

SEQ ID NO: 290 - protein, 12 aa, Artificial Sequence
  Description of Artificial Sequence: Synthetic peptide
  PD1-33[PD-1] vlCDR3
SSYTIVTNFEVL

SEQ ID NO: 291 - protein, 127 aa, Artificial Sequence
  Description of Artificial Sequence: Synthetic polypeptide
  PD1-35[PD-1] Variable heavy (vh) domain
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 292 - protein, 7 aa, Artificial Sequence
  Description of Artificial Sequence: Synthetic peptide
  PD1-35[PD-1] vhCDR1
SGAYYWS

SEQ ID NO: 293 - protein, 16 aa, Artificial Sequence
  Description of Artificial Sequence: Synthetic peptide
  PD1-35[PD-1] vhCDR2
YIYYNGNTYYNPSLRS

SEQ ID NO: 294 - protein, 17 aa, Artificial Sequence
  Description of Artificial Sequence: Synthetic peptide
  PD1-35[PD-1] vhCDR3
ASDYVWGGYRYMDAFDI

SEQ ID NO: 295 - protein, 112 aa, Artificial Sequence
  Description of Artificial Sequence: Synthetic polypeptide
  PD1-35[PD-1] Variable light (vl) domain
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 296 - protein, 13 aa, Artificial Sequence
  Description of Artificial Sequence: Synthetic peptide
  PD1-35[PD-1] vlCDR1
SGSNSNIGSNSVN

SEQ ID NO: 297 - protein, 7 aa, Artificial Sequence
  Description of Artificial Sequence: Synthetic peptide
  PD1-35[PD-1] vlCDR2
GNNQRPS

SEQ ID NO: 298 - protein, 11 aa, Artificial Sequence
  Description of Artificial Sequence: Synthetic peptide
  PD1-35[PD-1] vlCDR3
AAWDDSLNGPV

SEQ ID NO: 299 - protein, 127 aa, Artificial Sequence
  Description of Artificial Sequence: Synthetic polypeptide
  LOPD180[PD-1] Variable heavy (vh) domain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 300 - protein, 7 aa, Artificial Sequence
  Description of Artificial Sequence: Synthetic peptide
  LOPD180[PD-1] vhCDR1
SGAYYWS

SEQ ID NO: 301 - protein, 16 aa, Artificial Sequence
  Description of Artificial Sequence: Synthetic peptide
  LOPD180[PD-1] vhCDR2
YIYYNGNTYYNPSLRS

SEQ ID NO: 302 - protein, 17 aa, Artificial Sequence
  Description of Artificial Sequence: Synthetic peptide
  LOPD180[PD-1] vhCDR3
ASDYVWGGYHYFDAFDL

SEQ ID NO: 303 - protein, 110 aa, Artificial Sequence
  Description of Artificial Sequence: Synthetic polypeptide
  LOPD180[PD-1] Variable light (vl) domain
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 304 - protein, 13 aa, Artificial Sequence
  Description of Artificial Sequence: Synthetic peptide
  LOPD180[PD-1] vlCDR1
SGSNSNIGSNSVN

SEQ ID NO: 305 - protein, 7 aa, Artificial Sequence
  Description of Artificial Sequence: Synthetic peptide
  LOPD180[PD-1] vlCDR2
GNNQRPS

SEQ ID NO: 306 - protein, 11 aa, Artificial Sequence
  Description of Artificial Sequence: Synthetic peptide
  LOPD180[PD-1] vlCDR3
AAWDDSLNGPV

SEQ ID NO: 307 - protein, 119 aa, Artificial Sequence
  Description of Artificial Sequence: Synthetic polypeptide
  Ab948[PD-1] Variable heavy (vh) domain
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVS

SEQ ID NO: 308 - protein, 6 aa, Artificial Sequence
  Description of Artificial Sequence: Synthetic peptide
  Ab948[PD-1] vhCDR1
SDYAWN

SEQ ID NO: 309 - protein, 16 aa, Artificial Sequence
  Description of Artificial Sequence: Synthetic peptide
  Ab948[PD-1] vhCDR2
YINYSGSTSYNPSLKS

SEQ ID NO: 310 - protein, 11 aa, Artificial Sequence
  Description of Artificial Sequence: Synthetic peptide
  Ab948[PD-1] vhCDR3
WIGSSAWYFDV

SEQ ID NO: 311 - protein, 112 aa, Artificial Sequence
  Description of Artificial Sequence: Synthetic polypeptide
  Ab948[PD-1] Variable light (vl) domain
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 312 - protein, 16 aa, Artificial Sequence
  Description of Artificial Sequence: Synthetic peptide
  Ab948[PD-1] vlCDR1
RSGQNIVHSNGNTYLE

SEQ ID NO: 313 - protein, 7 aa, Artificial Sequence
  Description of Artificial Sequence: Synthetic peptide
  Ab948[PD-1] vlCDR2
KVSNRFF

SEQ ID NO: 314 - protein, 9 aa, Artificial Sequence
  Description of Artificial Sequence: Synthetic peptide
  Ab948[PD-1] vlCDR3
FQGSHVPFT

SEQ ID NO: 315 - protein, 121 aa, Artificial Sequence
  Description of Artificial Sequence: Synthetic polypeptide
  humanized EH-12.2H7[PD-1] Variable heavy (vh) domain
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 316 - protein, 5 aa, Artificial Sequence
  Description of Artificial Sequence: Synthetic peptide
  humanized EH-12.2H7[PD-1] vhCDR1
SSWIH

SEQ ID NO: 317 - protein, 17 aa, Artificial Sequence
  Description of Artificial Sequence: Synthetic peptide
  humanized EH-12.2H7[PD-1] vhCDR2
YIYPSTGFTEYNQKFKD

SEQ ID NO: 318 - protein, 12 aa, Artificial Sequence
  Description of Artificial Sequence: Synthetic peptide
  humanized EH-12.2H7[PD-1] vhCDR3
WRDSSGYHAMDY

SEQ ID NO: 319 - protein, 111 aa, Artificial Sequence
  Description of Artificial Sequence: Synthetic polypeptide
  humanized EH-12.2H7[PD-1] Variable light (vl) domain
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 320 - protein, 15 aa, Artificial Sequence
  Description of Artificial Sequence: Synthetic peptide
  humanized EH-12.2H7[PD-1] vlCDR1
RASQSVSTSGYSYMH

SEQ ID NO: 321 - protein, 7 aa, Artificial Sequence
  Description of Artificial Sequence: Synthetic peptide
  humanized EH-12.2H7[PD-1] vlCDR2
FGSNLES

SEQ ID NO: 322 - protein, 9 aa, Artificial Sequence
  Description of Artificial Sequence: Synthetic peptide
  humanized EH-12.2H7[PD-1] vlCDR3
QHSWEIPYT

SEQ ID NO: 323 - protein, 119 aa, Artificial Sequence
  Description of Artificial Sequence: Synthetic polypeptide
  RG1H10[PD-1] Variable heavy (vh) domain
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 324 - protein, 5 aa, Artificial Sequence
  Description of Artificial Sequence: Synthetic peptide
  RG1H10[PD-1] vhCDR1
DNGVN

SEQ ID NO: 325 - protein, 17 aa, Artificial Sequence
  Description of Artificial Sequence: Synthetic peptide
  RG1H10[PD-1] vhCDR2
WINTKIGNPTYAQGFTG

SEQ ID NO: 326 - protein, 10 aa, Artificial Sequence
  Description of Artificial Sequence: Synthetic peptide
  RG1H10[PD-1] vhCDR3
EHDYYYGMDV

SEQ ID NO: 327 - protein, 111 aa, Artificial Sequence
  Description of Artificial Sequence: Synthetic polypeptide
  RG1H10[PD-1] Variable light (vl) domain
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 328 - protein, 14 aa, Artificial Sequence
  Description of Artificial Sequence: Synthetic peptide
  RG1H10[PD-1] vlCDR1
TGTSSDVGGYNYVS

SEQ ID NO: 329 - protein, 7 aa, Artificial Sequence
  Description of Artificial Sequence: Synthetic peptide
  RG1H10[PD-1] vlCDR2
EVSKRPS

SEQ ID NO: 330 - protein, 11 aa, Artificial Sequence
  Description of Artificial Sequence: Synthetic peptide
  RG1H10[PD-1] vlCDR3
SAWDDSLNADV

SEQ ID NO: 331 - protein, 119 aa, Artificial Sequence
  Description of Artificial Sequence: Synthetic polypeptide
  RG1H10-H2A-22-1S[PD-1] Variable heavy (vh) domain
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 332 - protein, 5 aa, Artificial Sequence
  Description of Artificial Sequence: Synthetic peptide
  RG1H10-H2A-22-1S[PD-1] vhCDR1
DNGVN

SEQ ID NO: 333 - protein, 17 aa, Artificial Sequence
  Description of Artificial Sequence: Synthetic peptide
  RG1H10-H2A-22-1S[PD-1] vhCDR2
WINTKDGNPTYAQGFTG

SEQ ID NO: 334 - protein, 10 aa, Artificial Sequence
  Description of Artificial Sequence: Synthetic peptide
  RG1H10-H2A-22-1S[PD-1] vhCDR3
EHDYYYGMDV

SEQ ID NO: 335 - protein, 111 aa, Artificial Sequence; identical to SEQ ID NO: 327
  Description of Artificial Sequence: Synthetic polypeptide
  RG1H10-H2A-22-1S[PD-1] Variable light (vl) domain

SEQ ID NO: 336 - protein, 14 aa, Artificial Sequence
  Description of Artificial Sequence: Synthetic peptide
  RG1H10-H2A-22-1S[PD-1] vlCDR1
TGTSSDVGGYNYVS

SEQ ID NO: 337 - protein, 7 aa, Artificial Sequence
  Description of Artificial Sequence: Synthetic peptide
  RG1H10-H2A-22-1S[PD-1] vlCDR2
EVSKRPS

SEQ ID NO: 338 - protein, 11 aa, Artificial Sequence
  Description of Artificial Sequence: Synthetic peptide
  RG1H10-H2A-22-1S[PD-1] vlCDR3
SAWDDSLNADV

SEQ ID NO: 339 - protein, 119 aa, Artificial Sequence
  Description of Artificial Sequence: Synthetic polypeptide
  RG1H10-H2A-27-2S[PD-1] Variable heavy (vh) domain
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 340 - protein, 5 aa, Artificial Sequence
  Description of Artificial Sequence: Synthetic peptide
  RG1H10-H2A-27-2S[PD-1] vhCDR1
DNGVN

SEQ ID NO: 341 - protein, 17 aa, Artificial Sequence
  Description of Artificial Sequence: Synthetic peptide
  RG1H10-H2A-27-2S[PD-1] vhCDR2
WINTKTGNPTYAQGFTG

SEQ ID NO: 342 - protein, 10 aa, Artificial Sequence
  Description of Artificial Sequence: Synthetic peptide
  RG1H10-H2A-27-2S[PD-1] vhCDR3
EHDYYYGMDV

SEQ ID NO: 343 - protein, 111 aa, Artificial Sequence; identical to SEQ ID NO: 327
  Description of Artificial Sequence: Synthetic polypeptide
  RG1H10-H2A-27-2S[PD-1] Variable light (vl) domain

SEQ ID NO: 344 - protein, 14 aa, Artificial Sequence
  Description of Artificial Sequence: Synthetic peptide
  RG1H10-H2A-27-2S[PD-1] vlCDR1
TGTSSDVGGYNYVS

SEQ ID NO: 345 - protein, 7 aa, Artificial Sequence
  Description of Artificial Sequence: Synthetic peptide
  RG1H10-H2A-27-2S[PD-1] vlCDR2
EVSKRPS

SEQ ID NO: 346 - protein, 11 aa, Artificial Sequence
  Description of Artificial Sequence: Synthetic peptide
  RG1H10-H2A-27-2S[PD-1] vlCDR3
SAWDDSLNADV

SEQ ID NO: 347 - protein, 119 aa, Artificial Sequence
  Description of Artificial Sequence: Synthetic polypeptide
  RG1H10-3C[PD-1] Variable heavy (vh) domain
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 348 - protein, 5 aa, Artificial Sequence
  Description of Artificial Sequence: Synthetic peptide
  RG1H10-3C[PD-1] vhCDR1
DNGVN

SEQ ID NO: 349 - protein, 17 aa, Artificial Sequence
  Description of Artificial Sequence: Synthetic peptide
  RG1H10-3C[PD-1] vhCDR2
WINTKDGNPTYAQGFTG

SEQ ID NO: 350 - protein, 10 aa, Artificial Sequence
  Description of Artificial Sequence: Synthetic peptide
  RG1H10-3C[PD-1] vhCDR3
EHDYYYGMDV

SEQ ID NO: 351 - protein, 111 aa, Artificial Sequence; identical to SEQ ID NO: 327
  Description of Artificial Sequence: Synthetic polypeptide
  RG1H10-3C[PD-1] Variable light (vl) domain

SEQ ID NO: 352 - protein, 14 aa, Artificial Sequence
  Description of Artificial Sequence: Synthetic peptide
  RG1H10-3C[PD-1] vlCDR1
TGTSSDVGGYNYVS

SEQ ID NO: 353 - protein, 7 aa, Artificial Sequence
  Description of Artificial Sequence: Synthetic peptide
  RG1H10-3C[PD-1] vlCDR2
EVSKRPS

SEQ ID NO: 354 - protein, 11 aa, Artificial Sequence
  Description of Artificial Sequence: Synthetic peptide
  RG1H10-3C[PD-1] vlCDR3
SAWDDSLNADV

SEQ ID NO: 355 - protein, 118 aa, Artificial Sequence
  Description of Artificial Sequence: Synthetic polypeptide
  RG1H10-16C[PD-1] Variable heavy (vh) domain
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 356 - protein, 5 aa, Artificial Sequence
  Description of Artificial Sequence: Synthetic peptide
  RG1H10-16C[PD-1] vhCDR1
DNGVN

SEQ ID NO: 357 - protein, 17 aa, Artificial Sequence
  Description of Artificial Sequence: Synthetic peptide
  RG1H10-16C[PD-1] vhCDR2
WINTKTGNPTYAQGFTG

SEQ ID NO: 358 - protein, 10 aa, Artificial Sequence
  Description of Artificial Sequence: Synthetic peptide
  RG1H10-16C[PD-1] vhCDR3
EHDYYYGMDV

SEQ ID NO: 359 - protein, 111 aa, Artificial Sequence; identical to SEQ ID NO: 327
  Description of Artificial Sequence: Synthetic polypeptide
  RG1H10-16C[PD-1] Variable light (vl) domain

SEQ ID NO: 360 - protein, 14 aa, Artificial Sequence
  Description of Artificial Sequence: Synthetic peptide
  RG1H10-16C[PD-1] vlCDR1
TGTSSDVGGYNYVS

SEQ ID NO: 361 - protein, 7 aa, Artificial Sequence
  Description of Artificial Sequence: Synthetic peptide
  RG1H10-16C[PD-1] vlCDR2
EVSKRPS

SEQ ID NO: 362 - protein, 11 aa, Artificial Sequence
  Description of Artificial Sequence: Synthetic peptide
  RG1H10-16C[PD-1] vlCDR3
SAWDDSLNADV

SEQ ID NO: 363 - protein, 119 aa, Artificial Sequence
  Description of Artificial Sequence: Synthetic polypeptide
  RG1H10-17C[PD-1] Variable heavy (vh) domain
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 364 - protein, 5 aa, Artificial Sequence
  Description of Artificial Sequence: Synthetic peptide
  RG1H10-17C[PD-1] vhCDR1
DNGVN

SEQ ID NO: 365 - protein, 17 aa, Artificial Sequence
  Description of Artificial Sequence: Synthetic peptide
  RG1H10-17C[PD-1] vhCDR2
WINTKSGNPTYAQGFTG

SEQ ID NO: 366 - protein, 10 aa, Artificial Sequence
  Description of Artificial Sequence: Synthetic peptide
  RG1H10-17C[PD-1] vhCDR3
EHDYYYGMDV

SEQ ID NO: 367 - protein, 111 aa, Artificial Sequence; identical to SEQ ID NO: 327
  Description of Artificial Sequence: Synthetic polypeptide
  RG1H10-17C[PD-1] Variable light (vl) domain

SEQ ID NO: 368 - protein, 14 aa, Artificial Sequence
  Description of Artificial Sequence: Synthetic peptide
  RG1H10-17C[PD-1] vlCDR1
TGTSSDVGGYNYVS

SEQ ID NO: 369 - protein, 7 aa, Artificial Sequence
  Description of Artificial Sequence: Synthetic peptide
  RG1H10-17C[PD-1] vlCDR2
EVSKRPS

SEQ ID NO: 370 - protein, 11 aa, Artificial Sequence
  Description of Artificial Sequence: Synthetic peptide
  RG1H10-17C[PD-1] vlCDR3
SAWDDSLNADV

SEQ ID NO: 371 - protein, 119 aa, Artificial Sequence
  Description of Artificial Sequence: Synthetic polypeptide
  RG1H10-19C[PD-1] Variable heavy (vh) domain
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 372 - protein, 5 aa, Artificial Sequence
  Description of Artificial Sequence: Synthetic peptide
  RG1H10-19C[PD-1] vhCDR1
DNGVN

SEQ ID NO: 373 - protein, 17 aa, Artificial Sequence
  Description of Artificial Sequence: Synthetic peptide
  RG1H10-19C[PD-1] vhCDR2
WINTKTGNPTYAQGFTG

SEQ ID NO: 374 - protein, 10 aa, Artificial Sequence
  Description of Artificial Sequence: Synthetic peptide
  RG1H10-19C[PD-1] vhCDR3
EHDYYYGMDV

SEQ ID NO: 375 - protein, 111 aa, Artificial Sequence; identical to SEQ ID NO: 327
  Description of Artificial Sequence: Synthetic polypeptide
  RG1H10-19C[PD-1] Variable light (vl) domain

SEQ ID NO: 376 - protein, 14 aa, Artificial Sequence
  Description of Artificial Sequence: Synthetic peptide
  RG1H10-19C[PD-1] vlCDR1
TGTSSDVGGYNYVS

SEQ ID NO: 377 - protein, 7 aa, Artificial Sequence
  Description of Artificial Sequence: Synthetic peptide
  RG1H10-19C[PD-1] vlCDR2
EVSKRPS

SEQ ID NO: 378 - protein, 11 aa, Artificial Sequence
  Description of Artificial Sequence: Synthetic peptide
  RG1H10-19C[PD-1] vlCDR3
SAWDDSLNADV

SEQ ID NO: 379 - protein, 119 aa, Artificial Sequence
  Description of Artificial Sequence: Synthetic polypeptide
  RG1H10-21C[PD-1] Variable heavy (vh) domain
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 380 - protein, 5 aa, Artificial Sequence
  Description of Artificial Sequence: Synthetic peptide
  RG1H10-21C[PD-1] vhCDR1
DNGVN

SEQ ID NO: 381 - protein, 17 aa, Artificial Sequence
  Description of Artificial Sequence: Synthetic peptide
  RG1H10-21C[PD-1] vhCDR2
WINTKSGNPTYAQGFTG

SEQ ID NO: 382 - protein, 10 aa, Artificial Sequence
  Description of Artificial Sequence: Synthetic peptide
  RG1H10-21C[PD-1] vhCDR3
EHDYYYGMDV

SEQ ID NO: 383 - protein, 111 aa, Artificial Sequence; identical to SEQ ID NO: 327
  Description of Artificial Sequence: Synthetic polypeptide
  RG1H10-21C[PD-1] Variable light (vl) domain

SEQ ID NO: 384 - protein, 14 aa, Artificial Sequence
  Description of Artificial Sequence: Synthetic peptide
  RG1H10-21C[PD-1] vlCDR1
TGTSSDVGGYNYVS

SEQ ID NO: 385 - protein, 7 aa, Artificial Sequence
  Description of Artificial Sequence: Synthetic peptide
  RG1H10-21C[PD-1] vlCDR2
EVSKRPS

SEQ ID NO: 386 - protein, 11 aa, Artificial Sequence
  Description of Artificial Sequence: Synthetic peptide
  RG1H10-21C[PD-1] vlCDR3
SAWDDSLNADV

SEQ ID NO: 387 - protein, 119 aa, Artificial Sequence
  Description of Artificial Sequence: Synthetic polypeptide
  RG1H10-23C2[PD-1] Variable heavy (vh) domain
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 388 - protein, 5 aa, Artificial Sequence
  Description of Artificial Sequence: Synthetic peptide
  RG1H10-23C2[PD-1] vhCDR1
DNGVN

SEQ ID NO: 389 - protein, 16 aa, Artificial Sequence
  Description of Artificial Sequence: Synthetic peptide
  RG1H10-23C2[PD-1] vhCDR2
WINTKDGNPTYAQGFT

SEQ ID NO: 390 - protein, 10 aa, Artificial Sequence
  Description of Artificial Sequence: Synthetic peptide
  RG1H10-23C2[PD-1] vhCDR3
EHDYYYGMDV

SEQ ID NO: 391 - protein, 111 aa, Artificial Sequence; identical to SEQ ID NO: 327
  Description of Artificial Sequence: Synthetic polypeptide
  RG1H10-23C2[PD-1] Variable light (vl) domain

SEQ ID NO: 392 - protein, 14 aa, Artificial Sequence
  Description of Artificial Sequence: Synthetic peptide
  RG1H10-23C2[PD-1] vlCDR1
TGTSSDVGGYNYVS

SEQ ID NO: 393 - protein, 7 aa, Artificial Sequence
  Description of Artificial Sequence: Synthetic peptide
  RG1H10-23C2[PD-1] vlCDR2
EVSKRPS

SEQ ID NO: 394 - protein, 11 aa, Artificial Sequence
  Description of Artificial Sequence: Synthetic peptide
  RG1H10-23C2[PD-1] vlCDR3
SAWDDSLNADV

SEQ ID NO: 395 - protein, 117 aa, Artificial Sequence
  Description of Artificial Sequence: Synthetic polypeptide
  mAb7[PD-1] Variable heavy (vh) domain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 396 - protein, 5 aa, Artificial Sequence
  Description of Artificial Sequence: Synthetic peptide
  mAb7[PD-1] vhCDR1
SYWIN

SEQ ID NO: 397 - protein, 17 aa, Artificial Sequence
  Description of Artificial Sequence: Synthetic peptide
  mAb7[PD-1] vhCDR2
NIYPGSSLTNYNEKFKN

SEQ ID NO: 398 - protein, 8 aa, Artificial Sequence
  Description of Artificial Sequence: Synthetic peptide
  mAb7[PD-1] vhCDR3
LSTGTFAY

SEQ ID NO: 399 - protein, 113 aa, Artificial Sequence
  Description of Artificial Sequence: Synthetic polypeptide
  mAb7[PD-1] Variable light (vl) domain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 400 - protein, 17 aa, Artificial Sequence
  Description of Artificial Sequence: Synthetic peptide
  mAb7[PD-1] vlCDR1
KSSQSLWDSGNQKNFLT

SEQ ID NO: 401 - protein, 7 aa, Artificial Sequence
  Description of Artificial Sequence: Synthetic peptide
  mAb7[PD-1] vlCDR2
WTSYRES

SEQ ID NO: 402 - protein, 9 aa, Artificial Sequence
  Description of Artificial Sequence: Synthetic peptide
  mAb7[PD-1] vlCDR3
QNDYFYPHT

SEQ ID NO: 403 - protein, 124 aa, Artificial Sequence
  Description of Artificial Sequence: Synthetic polypeptide
  PD1AB-6[PD-1] Variable heavy (vh) domain
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 404 - protein, 5 aa, Artificial Sequence
  Description of Artificial Sequence: Synthetic peptide
  PD1AB-6[PD-1] vhCDR1
DTYMH

SEQ ID NO: 405 - protein, 17 aa, Artificial Sequence
  Description of Artificial Sequence: Synthetic peptide
  PD1AB-6[PD-1] vhCDR2
RIDPANGDRKYDPKFQG

SEQ ID NO: 406 - protein, 15 aa, Artificial Sequence
  Description of Artificial Sequence: Synthetic peptide
  PD1AB-6[PD-1] vhCDR3
SGPVYYYGSSYVMDY

SEQ ID NO: 407 - protein, 112 aa, Artificial Sequence
  Description of Artificial Sequence: Synthetic polypeptide
  PD1AB-6[PD-1] Variable light (vl) domain
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 408 - protein, 17 aa, Artificial Sequence
  Description of Artificial Sequence: Synthetic peptide
  PD1AB-6[PD-1] vlCDR1
KSGQSVLYSSNQKNFLA

SEQ ID NO: 409 - protein, 7 aa, Artificial Sequence
  Description of Artificial Sequence: Synthetic peptide
  PD1AB-6[PD-1] vlCDR2
WASTRES

SEQ ID NO: 410 - protein, 8 aa, Artificial Sequence
  Description of Artificial Sequence: Synthetic peptide
  PD1AB-6[PD-1] vlCDR3
HQYLYSWT

SEQ ID NO: 411 - protein, 117 aa, Artificial Sequence
  Description of Artificial Sequence: Synthetic polypeptide
  1C11[PD-1]_H0L0 Variable heavy (vh) domain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 412 - protein, 5 aa, Artificial Sequence
  Description of Artificial Sequence: Synthetic peptide
  1C11[PD-1]_H0L0 vhCDR1
HYGMN

SEQ ID NO: 413 - protein, 17 aa, Artificial Sequence
  Description of Artificial Sequence: Synthetic peptide
  1C11[PD-1]_H0L0 vhCDR2
WINTYTGEPTYADDFKG

SEQ ID NO: 414 - protein, 8 aa, Artificial Sequence
  Description of Artificial Sequence: Synthetic peptide
  1C11[PD-1]_H0L0 vhCDR3
DYYGSSPY

SEQ ID NO: 415 - protein, 112 aa, Artificial Sequence
  Description of Artificial Sequence: Synthetic polypeptide
  1C11[PD-1]_H0L0 Variable light (vl) domain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 416 - protein, 16 aa, Artificial Sequence
  Description of Artificial Sequence: Synthetic peptide
  1C11[PD-1]_H0L0 vlCDR1
RSSQSIVHSNGNTYLE

SEQ ID NO: 417 - protein, 7 aa, Artificial Sequence
  Description of Artificial Sequence: Synthetic peptide
  1C11[PD-1]_H0L0 vlCDR2
KVSNRFS

SEQ ID NO: 418 - protein, 8 aa, Artificial Sequence
  Description of Artificial Sequence: Synthetic peptide
  1C11[PD-1]_H0L0 vlCDR3
QGSHVPNT

SEQ ID NO: 419 - protein, 117 aa, Artificial Sequence
  Description of Artificial Sequence: Synthetic polypeptide
  1C11[PD-1]_H3L3 Variable heavy (vh) domain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 420 - protein, 5 aa, Artificial Sequence
  Description of Artificial Sequence: Synthetic peptide
  1C11[PD-1]_H3L3 vhCDR1
HYGMN

SEQ ID NO: 421 - protein, 17 aa, Artificial Sequence
  Description of Artificial Sequence: Synthetic peptide
  1C11[PD-1]_H3L3 vhCDR2
WINTYTGEPTYADGFTG

SEQ ID NO: 422 - protein, 8 aa, Artificial Sequence
  Description of Artificial Sequence: Synthetic peptide
  1C11[PD-1]_H3L3 vhCDR3
DYYGSSPY

SEQ ID NO: 423 - protein, 112 aa, Artificial Sequence
  Description of Artificial Sequence: Synthetic polypeptide
  1C11[PD-1]_H3L3 Variable light (vl) domain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 424 - protein, 16 aa, Artificial Sequence
  Description of Artificial Sequence: Synthetic peptide
  1C11[PD-1]_H3L3 vlCDR1
KSSQSIVHSNGNTYLE

SEQ ID NO: 425 - protein, 7 aa, Artificial Sequence
  Description of Artificial Sequence: Synthetic peptide
  1C11[PD-1]_H3L3 vlCDR2
KVSNRFS

SEQ ID NO: 426 - protein, 9 aa, Artificial Sequence
  Description of Artificial Sequence: Synthetic peptide
  1C11[PD-1]_H3L3 vlCDR3
FQGSHVPNT

SEQ ID NO: 427 - protein, 117 aa, Artificial Sequence
  Description of Artificial Sequence: Synthetic polypeptide
  1C11[PD-1]_H3.240_L3.148 Variable heavy (vh) domain
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 428 - protein, 5 aa, Artificial Sequence
  Description of Artificial Sequence: Synthetic peptide
  1C11[PD-1]_H3.240_L3.148 vhCDR1
HYGIN

SEQ ID NO: 429 - protein, 17 aa, Artificial Sequence
  Description of Artificial Sequence: Synthetic peptide
  1C11[PD-1]_H3.240_L3.148 vhCDR2
WINTYTGEPYYAPGFQE

SEQ ID NO: 430 - protein, 8 aa, Artificial Sequence
  Description of Artificial Sequence: Synthetic peptide
  1C11[PD-1]_H3.240_L3.148 vhCDR3
DYYGSSPY

SEQ ID NO: 431 - protein, 112 aa, Artificial Sequence
  Description of Artificial Sequence: Synthetic polypeptide
  1C11[PD-1]_H3.240_L3.148 Variable light (vl) domain
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 432 - protein, 16 aa, Artificial Sequence
  Description of Artificial Sequence: Synthetic peptide
  1C11[PD-1]_H3.240_L3.148 vlCDR1
KASQSIVHSNGNTYLE

SEQ ID NO: 433 - protein, 7 aa, Artificial Sequence
  Description of Artificial Sequence: Synthetic peptide
  1C11[PD-1]_H3.240_L3.148 vlCDR2
KVSNRFS

SEQ ID NO: 434 - protein, 9 aa, Artificial Sequence
  Description of Artificial Sequence: Synthetic peptide
  1C11[PD-1]_H3.240_L3.148 vlCDR3
FQGSHVPNT

SEQ ID NO: 435 - protein, 117 aa, Artificial Sequence
  Description of Artificial Sequence: Synthetic polypeptide
  1C11[PD-1]_H3.241_L3.148 Variable heavy (vh) domain
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 436 - protein, 5 aa, Artificial Sequence
  Description of Artificial Sequence: Synthetic peptide
  1C11[PD-1]_H3.241_L3.148 vhCDR1
HYGIN

SEQ ID NO: 437 - protein, 17 aa, Artificial Sequence
  Description of Artificial Sequence: Synthetic peptide
  1C11[PD-1]_H3.241_L3.148 vhCDR2
WINTYTGEPYYAPGFQE

SEQ ID NO: 438 - protein, 8 aa, Artificial Sequence
  Description of Artificial Sequence: Synthetic peptide
  1C11[PD-1]_H3.241_L3.148 vhCDR3
DYYGSSPY

SEQ ID NO: 439 - protein, 112 aa, Artificial Sequence; identical to SEQ ID NO: 431
  Description of Artificial Sequence: Synthetic polypeptide
  1C11[PD-1]_H3.241_L3.148 Variable light (vl) domain

SEQ ID NO: 440 - protein, 16 aa, Artificial Sequence
  Description of Artificial Sequence: Synthetic peptide
  1C11[PD-1]_H3.241_L3.148 vlCDR1
KASQSIVHSNGNTYLE

SEQ ID NO: 441 - protein, 7 aa, Artificial Sequence
  Description of Artificial Sequence: Synthetic peptide
  1C11[PD-1]_H3.241_L3.148 vlCDR2
KVSNRFS

SEQ ID NO: 442 - protein, 9 aa, Artificial Sequence
  Description of Artificial Sequence: Synthetic peptide
  1C11[PD-1]_H3.241_L3.148 vlCDR3
FQGSHVPNT

SEQ ID NO: 443 - protein, 117 aa, Artificial Sequence
  Description of Artificial Sequence: Synthetic polypeptide
  1C11[PD-1]_H3.234_L3.144 Variable heavy (vh) domain
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSS

SEQ ID NO: 444 - protein, 5 aa, Artificial Sequence
  Description of Artificial Sequence: Synthetic peptide
  1C11[PD-1]_H3.234_L3.144 vhCDR1
HYGIN

SEQ ID NO: 445 - protein, 17 aa, Artificial Sequence
  Description of Artificial Sequence: Synthetic peptide
  1C11[PD-1]_H3.234_L3.144 vhCDR2
WINTYTGEPYYAPGFQE

SEQ ID NO: 446 - protein, 8 aa, Artificial Sequence
  Description of Artificial Sequence: Synthetic peptide
  1C11[PD-1]_H3.234_L3.144 vhCDR3
DYYGSSPY

SEQ ID NO: 447 - protein, 112 aa, Artificial Sequence
  Description of Artificial Sequence: Synthetic polypeptide
  1C11[PD-1]_H3.234_L3.144 Variable light (vl) domain
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 448 - protein, 16 aa, Artificial Sequence
  Description of Artificial Sequence: Synthetic peptide
  1C11[PD-1]_H3.234_L3.144 vlCDR1
KASQSIVHSNGNTYLE

SEQ ID NO: 449 - protein, 7 aa, Artificial Sequence
  Description of Artificial Sequence: Synthetic peptide
  1C11[PD-1]_H3.234_L3.144 vlCDR2
KVSNRFS

SEQ ID NO: 450 - protein, 9 aa, Artificial Sequence
  Description of Artificial Sequence: Synthetic peptide
  1C11[PD-1]_H3.234_L3.144 vlCDR3
FQGSHVPNT

SEQ ID NO: 451 - protein, 117 aa, Artificial Sequence; identical to SEQ ID NO: 435
  Description of Artificial Sequence: Synthetic polypeptide
  1C11[PD-1]_H3.241_L3.92 Variable heavy (vh) domain

SEQ ID NO: 452 - protein, 5 aa, Artificial Sequence
  Description of Artificial Sequence: Synthetic peptide
  1C11[PD-1]_H3.241_L3.92 vhCDR1
HYGIN

SEQ ID NO: 453 - protein, 17 aa, Artificial Sequence
  Description of Artificial Sequence: Synthetic peptide
  1C11[PD-1]_H3.241_L3.92 vhCDR2
WINTYTGEPYYAPGFQE

SEQ ID NO: 454 - protein, 8 aa, Artificial Sequence
  Description of Artificial Sequence: Synthetic peptide
  1C11[PD-1]_H3.241_L3.92 vhCDR3
DYYGSSPY

SEQ ID NO: 455 - protein, 112 aa, Artificial Sequence
  Description of Artificial Sequence: Synthetic polypeptide
  1C11[PD-1]_H3.241_L3.92 Variable light (vl) domain
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 456 - protein, 16 aa, Artificial Sequence
  Description of Artificial Sequence: Synthetic peptide
  1C11[PD-1]_H3.241_L3.92 vlCDR1
KASQSIVHSNGNTYLE

SEQ ID NO: 457 - protein, 7 aa, Artificial Sequence
  Description of Artificial Sequence: Synthetic peptide
  1C11[PD-1]_H3.241_L3.92 vlCDR2
KVSNRFT

SEQ ID NO: 458 - protein, 9 aa, Artificial Sequence
  Description of Artificial Sequence: Synthetic peptide
  1C11[PD-1]_H3.241_L3.92 vlCDR3
FQGSHVPNT

SEQ ID NO: 459 - protein, 117 aa, Artificial Sequence
  Description of Artificial Sequence: Synthetic polypeptide
  1C11[PD-1]_H3.303_L3.152 Variable heavy (vh) domain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 460 - protein, 5 aa, Artificial Sequence
  Description of Artificial Sequence: Synthetic peptide
  1C11[PD-1]_H3.303_L3.152 vhCDR1
HYGMN

SEQ ID NO: 461 - protein, 17 aa, Artificial Sequence
  Description of Artificial Sequence: Synthetic peptide
  1C11[PD-1]_H3.303_L3.152 vhCDR2
WINTYTGEPTYADGFTG

SEQ ID NO: 462 - protein, 8 aa, Artificial Sequence
  Description of Artificial Sequence: Synthetic peptide
  1C11[PD-1]_H3.303_L3.152 vhCDR3
DYFGSSPY

SEQ ID NO: 463 - protein, 112 aa, Artificial Sequence
  Description of Artificial Sequence: Synthetic polypeptide
  1C11[PD-1]_H3.303_L3.152 Variable light (vl) domain
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 464 - protein, 16 aa, Artificial Sequence
  Description of Artificial Sequence: Synthetic peptide
  1C11[PD-1]_H3.303_L3.152 vlCDR1
KSSQSIVFSNGNTYLE

SEQ ID NO: 465 - protein, 7 aa, Artificial Sequence
  Description of Artificial Sequence: Synthetic peptide
  1C11[PD-1]_H3.303_L3.152 vlCDR2
KVSNRFS

SEQ ID NO: 466 - protein, 9 aa, Artificial Sequence
  Description of Artificial Sequence: Synthetic peptide
  1C11[PD-1]_H3.303_L3.152 vlCDR3
FQGSHVPNT

SEQ ID NO: 467 - protein, 117 aa, Artificial Sequence
  Description of Artificial Sequence: Synthetic polypeptide
  1C11_H3.329_L3.220 Variable heavy (vh) domain
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 468 - protein, 5 aa, Artificial Sequence
  Description of Artificial Sequence: Synthetic peptide
  1C11_H3.329_L3.220 vhCDR1
HYGMN

SEQ ID NO: 469 - protein, 17 aa, Artificial Sequence
  Description of Artificial Sequence: Synthetic peptide
  1C11_H3.329_L3.220 vhCDR2
WINTHTGEPTYADGFTG

SEQ ID NO: 470 - protein, 8 aa, Artificial Sequence
  Description of Artificial Sequence: Synthetic peptide
  1C11_H3.329_L3.220 vhCDR3
DYFGSSPY

SEQ ID NO: 471 - protein, 112 aa, Artificial Sequence
  Description of Artificial Sequence: Synthetic polypeptide
  1C11_H3.329_L3.220 Variable light (vl) domain
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 472 - protein, 16 aa, Artificial Sequence
  Description of Artificial Sequence: Synthetic peptide
  1C11_H3.329_L3.220 vlCDR1
KSSQSIVYSNGNNYLE

SEQ ID NO: 473 - protein, 7 aa, Artificial Sequence
  Description of Artificial Sequence: Synthetic peptide
  1C11_H3.329_L3.220 vlCDR2
KVSNRFS

SEQ ID NO: 474 - protein, 9 aa, Artificial Sequence
  Description of Artificial Sequence: Synthetic peptide
  1C11_H3.329_L3.220 vlCDR3
FQGSHVPNT

SEQ ID NO: 475 - protein, 117 aa, Artificial Sequence
  Description of Artificial Sequence: Synthetic polypeptide
  1C11_H3.328_L3.152 Variable heavy (vh) domain
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 476 - protein, 5 aa, Artificial Sequence
  Description of Artificial Sequence: Synthetic peptide
  1C11_H3.328_L3.152 vhCDR1
HYGMN

SEQ ID NO: 477 - protein, 17 aa, Artificial Sequence
  Description of Artificial Sequence: Synthetic peptide
  1C11_H3.328_L3.152 vhCDR2
WINTHTGEPTYADGFTG

SEQ ID NO: 478 - protein, 8 aa, Artificial Sequence
  Description of Artificial Sequence: Synthetic peptide
  1C11_H3.328_L3.152 vhCDR3
DYFGSSPY

SEQ ID NO: 479 - protein, 112 aa, Artificial Sequence; identical to SEQ ID NO: 463
  Description of Artificial Sequence: Synthetic polypeptide
  1C11_H3.328_L3.152 Variable light (vl) domain

SEQ ID NO: 480 - protein, 15 aa, Artificial Sequence
  Description of Artificial Sequence: Synthetic peptide
  1C11_H3.328_L3.152 vlCDR1
KSSQSIVFSNGNTYL

SEQ ID NO: 481 - protein, 7 aa, Artificial Sequence
  Description of Artificial Sequence: Synthetic peptide
  1C11_H3.328_L3.152 vlCDR2
KVSNRFS

SEQ ID NO: 482 - protein, 9 aa, Artificial Sequence
  Description of Artificial Sequence: Synthetic peptide
  1C11_H3.328_L3.152 vlCDR3
FQGSHVPNT

SEQ ID NO: 483 - protein, 119 aa, Artificial Sequence
  Description of Artificial Sequence: Synthetic polypeptide
  mAb C[PD-1]_H1 Variable heavy (vh) domain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 484 - protein, 5 aa, Artificial Sequence
  Description of Artificial Sequence: Synthetic peptide
  mAb C[PD-1]_H1 vhCDR1
SFGMH

SEQ ID NO: 485 - protein, 17 aa, Artificial Sequence
  Description of Artificial Sequence: Synthetic peptide
  mAb C[PD-1]_H1 vhCDR2
YISSGSSIIYYADSVKG

SEQ ID NO: 486 - protein, 10 aa, Artificial Sequence
  Description of Artificial Sequence: Synthetic peptide
  mAb C[PD-1]_H1 vhCDR3
GGRLVWSPDY

SEQ ID NO: 487 - protein, 119 aa, Artificial Sequence
  Description of Artificial Sequence: Synthetic polypeptide
  mAb C[PD-1]_H1.19 Variable heavy (vh) domain
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 488 - protein, 5 aa, Artificial Sequence
  Description of Artificial Sequence: Synthetic peptide
  mAb C[PD-1]_H1.19 vhCDR1
SLGMH

SEQ ID NO: 489 - protein, 17 aa, Artificial Sequence
  Description of Artificial Sequence: Synthetic peptide
  mAb C[PD-1]_H1.19 vhCDR2
YISSGSSIIYYADSVKG

SEQ ID NO: 490 - protein, 10 aa, Artificial Sequence
  Description of Artificial Sequence: Synthetic peptide
  mAb C[PD-1]_H1.19 vhCDR3
GGRLVWSPDY

SEQ ID NO: 491 - protein, 119 aa, Artificial Sequence
  Description of Artificial Sequence: Synthetic polypeptide
  mAb C[PD-1]_H1.48 Variable heavy (vh) domain
EVQLVESGGGLVQPGGSLRLSCAASGFTFSSFGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 492 - protein, 5 aa, Artificial Sequence
  Description of Artificial Sequence: Synthetic peptide
  mAb C[PD-1]_H1.48 vhCDR1
SFGMH

SEQ ID NO: 493 - protein, 17 aa, Artificial Sequence
  Description of Artificial Sequence: Synthetic peptide
  mAb C[PD-1]_H1.48 vhCDR2
YISGGSSIIYYADSVKG

SEQ ID NO: 494 - protein, 10 aa, Artificial Sequence
  Description of Artificial Sequence: Synthetic peptide
  mAb C[PD-1]_H1.48 vhCDR3
GGRLVWSPDY

SEQ ID NO: 495 - protein, 119 aa, Artificial Sequence
  Description of Artificial Sequence: Synthetic polypeptide
  mAb C[PD-1]_H1.125 Variable heavy (vh) domain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGELVWSPDYWGQGTLVTVSS

SEQ ID NO: 496 - protein, 5 aa, Artificial Sequence
  Description of Artificial Sequence: Synthetic peptide
  mAb C[PD-1]_H1.125 vhCDR1
SFGMH

SEQ ID NO: 497 - protein, 16 aa, Artificial Sequence
  Description of Artificial Sequence: Synthetic peptide
  mAb C[PD-1]_H1.125 vhCDR2
YISSGSSIIYYADSVK

SEQ ID NO: 498 - protein, 10 aa, Artificial Sequence
  Description of Artificial Sequence: Synthetic peptide
  mAb C[PD-1]_H1.125 vhCDR3
GGELVWSPDY

SEQ ID NO: 499 - protein, 119 aa, Artificial Sequence
  Description of Artificial Sequence: Synthetic polypeptide
  mAb C[PD-1]_H1.130 Variable heavy (vh) domain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGYLVWSPDYWGQGTLVTVSS

SEQ ID NO: 500 - protein, 9 aa, Artificial Sequence
  Description of Artificial Sequence: Synthetic peptide
  mAb C[PD-1]_L1.45 vlCDR3
QNDYSYPFT

SEQ ID NO: 501 - protein, 113 aa, Artificial Sequence
  Description of Artificial Sequence: Synthetic polypeptide
  mAb C[PD-1]_L1.117 Variable light (vl) domain
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 502 - protein, 17 aa, Artificial Sequence
  Description of Artificial Sequence: Synthetic peptide
  mAb C[PD-1]_L1.117 vlCDR1
KSSQSLLNSGNQKNYLT

SEQ ID NO: 503 - protein, 7 aa, Artificial Sequence
  Description of Artificial Sequence: Synthetic peptide
  mAb C[PD-1]_L1.117 vlCDR2
WASTRES

SEQ ID NO: 504 - protein, 9 aa, Artificial Sequence
  Description of Artificial Sequence: Synthetic peptide
  mAb C[PD-1]_L1.117 vlCDR3
QNDYTYPFT

SEQ ID NO: 505 - protein, 113 aa, Artificial Sequence
  Description of Artificial Sequence: Synthetic polypeptide
  mAb C[PD-1]_L1.129 Variable light (vl) domain
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSWPFTFGSGTKLEIK

SEQ ID NO: 506 - protein, 17 aa, Artificial Sequence
  Description of Artificial Sequence: Synthetic peptide
  mAb C[PD-1]_L1.129 vlCDR1
KSSQSLLNSGNQKNYLT

SEQ ID NO: 507 - protein, 7 aa, Artificial Sequence
  Description of Artificial Sequence: Synthetic peptide
  mAb C[PD-1]_L1.129 vlCDR2
WASTRES

SEQ ID NO: 508 - protein, 9 aa, Artificial Sequence
  Description of Artificial Sequence: Synthetic peptide
  mAb C[PD-1]_L1.129 vlCDR3
QNDYSWPFT

SEQ ID NO: 509 - protein, 113 aa, Artificial Sequence
  Description of Artificial Sequence: Synthetic polypeptide
  mAb C[PD-1]_L1.135 Variable light (vl) domain
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 510 - protein, 17 aa, Artificial Sequence
  Description of Artificial Sequence: Synthetic peptide
  mAb C[PD-1]_L1.135 vlCDR1
KSSQSLLHSGNQYNYLT

SEQ ID NO: 511 - protein, 7 aa, Artificial Sequence
  Description of Artificial Sequence: Synthetic peptide
  mAb C[PD-1]_L1.135 vlCDR2
WASTRES

SEQ ID NO: 512 - protein, 9 aa, Artificial Sequence
  Description of Artificial Sequence: Synthetic peptide
  mAb C[PD-1]_L1.135 vlCDR3
QNDYSYPFT

SEQ ID NO: 513 - protein, 113 aa, Artificial Sequence
  Description of Artificial Sequence: Synthetic polypeptide
  mAb C[PD-1]_L1.136 Variable light (vl) domain
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 514 - protein, 17 aa, Artificial Sequence
  Description of Artificial Sequence: Synthetic peptide
  mAb C[PD-1]_L1.136 vlCDR1
KSSQSLLHSGNQKNYLT

SEQ ID NO: 515 - protein, 7 aa, Artificial Sequence
  Description of Artificial Sequence: Synthetic peptide
  mAb C[PD-1]_L1.136 vlCDR2
WASTRES

SEQ ID NO: 516 - protein, 9 aa, Artificial Sequence
  Description of Artificial Sequence: Synthetic peptide
  mAb C[PD-1]_L1.136 vlCDR3
QNDYTYPFT

SEQ ID NO: 517 - protein, 113 aa, Artificial Sequence
  Description of Artificial Sequence: Synthetic polypeptide
  mAb C[PD-1]_L1.140 Variable light (vl) domain
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIK

SEQ ID NO: 518 - protein, 17 aa, Artificial Sequence
  Description of Artificial Sequence: Synthetic peptide
  mAb C[PD-1]_L1.140 vlCDR1
KSSQSLLHSGNQYNYLT

SEQ ID NO: 519 - protein, 7 aa, Artificial Sequence
  Description of Artificial Sequence: Synthetic peptide
  mAb C[PD-1]_L1.140 vlCDR2
WASTRES

SEQ ID NO: 520 - protein, 9 aa, Artificial Sequence
  Description of Artificial Sequence: Synthetic peptide
  mAb C[PD-1]_L1.140 vlCDR3
QNDYTYPFT

SEQ ID NO: 521 - protein, 113 aa, Artificial Sequence
  Description of Artificial Sequence: Synthetic polypeptide
  mAb C[PD-1]_L2 Variable light (vl) domain
DIVMTQSPLSLPVTPGEPASISCRSSQSLLNSGNQKNYLTWYLQKPGQPPQLLIYWASTRESGVPDRFTGSGSGTDFTLKISRVEAEDVGVYYCQNDYSYPFTFGSGTKLEIK

SEQ ID NO: 522 - protein, 16 aa, Artificial Sequence
  Description of Artificial Sequence: Synthetic peptide
  mAb C[PD-1]_L2 vlCDR1
RSSQSLLNSGNQKNYL

SEQ ID NO: 523 - protein, 7 aa, Artificial Sequence
  Description of Artificial Sequence: Synthetic peptide
  mAb C[PD-1]_L2 vlCDR2
WASTRES

SEQ ID NO: 524 - protein, 9 aa, Artificial Sequence
  Description of Artificial Sequence: Synthetic peptide
  mAb C[PD-1]_L2 vlCDR3
QNDYSYPFT

SEQ ID NO: 525 - protein, 121 aa, Artificial Sequence
  Description of Artificial Sequence: Synthetic polypeptide
  TGF1 Variable heavy (vh) domain
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 526 - protein, 7 aa, Artificial Sequence
  Description of Artificial Sequence: Synthetic peptide
  TGF1 vhCDR1
NSYFSWG

SEQ ID NO: 527 - protein, 16 aa, Artificial Sequence
  Description of Artificial Sequence: Synthetic peptide
  TGF1 vhCDR2
SFYYGEKTYYNPSLKS

SEQ ID NO: 528 - protein, 11 aa, Artificial Sequence
  Description of Artificial Sequence: Synthetic peptide
  TGF1 vhCDR3
GPTMIRGVIDS

SEQ ID NO: 529 - protein, 107 aa, Artificial Sequence
  Description of Artificial Sequence: Synthetic polypeptide
  TGF1 Variable light (vl) domain
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 530 - protein, 11 aa, Artificial Sequence
  Description of Artificial Sequence: Synthetic peptide
  TGF1 vlCDR1
RASQSVRSYLA

SEQ ID NO: 531 - protein, 7 aa, Artificial Sequence
  Description of Artificial Sequence: Synthetic peptide
  TGF1 vlCDR2
DASNRAT

SEQ ID NO: 532 - protein, 9 aa, Artificial Sequence
  Description of Artificial Sequence: Synthetic peptide
  TGF1 vlCDR3
QQRSNWPPT

SEQ ID NO: 533 - protein, 123 aa, Artificial Sequence
  Description of Artificial Sequence: Synthetic polypeptide
  TGF2 Variable heavy (vh) domain
QVQLVQSGAAVKKPGESLKISCKGSGYRFTSYWIGWVRQMPGKGLEWMGIIYPGDSDTRYSPSFQGQVTISAGKSISTAYLQWSSLKASDTAMYYCARHGRGYNGYEGAFDIWGQGTMVTVSS

SEQ ID NO: 534 - protein, 5 aa, Artificial Sequence
  Description of Artificial Sequence: Synthetic peptide
  TGF2 vhCDR1
SYWIG

SEQ ID NO: 535 - protein, 17 aa, Artificial Sequence
  Description of Artificial Sequence: Synthetic peptide
  TGF2 vhCDR2
IIYPGDSDTRYSPSFQG

SEQ ID NO: 536 - protein, 14 aa, Artificial Sequence
  Description of Artificial Sequence: Synthetic peptide
  TGF2 vhCDR3
HGRGYNGYEGAFDI

SEQ ID NO: 537 - protein, 107 aa, Artificial Sequence
  Description of Artificial Sequence: Synthetic polypeptide
  TGF2 Variable light (vl) domain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPWTFGQGTKVEIK

SEQ ID NO: 538 - protein, 11 aa, Artificial Sequence
  Description of Artificial Sequence: Synthetic peptide
  TGF2 vlCDR1
RASQGISSWLA

SEQ ID NO: 539 - protein, 7 aa, Artificial Sequence
  Description of Artificial Sequence: Synthetic peptide
  TGF2 vlCDR2
AASSLQS

SEQ ID NO: 540 - protein, 9 aa, Artificial Sequence
  Description of Artificial Sequence: Synthetic peptide
  TGF2 vlCDR3
QQYNSYPWT

SEQ ID NO: 541 - protein, 121 aa, Artificial Sequence
  Description of Artificial Sequence: Synthetic polypeptide
  TGF3 Variable heavy (vh) domain
QLQLQESGPGLVKPSETLSLTCTVSGGSISSSSYSWGWIRQPPGKGLEWIGSFYYSGITYYSPSLKSRIIISEDTSKNQFSLKLSSVTAADTAVYYCASGFTMIRGALDYWGQGTLVTVSS

SEQ ID NO: 542 - protein, 7 aa, Artificial Sequence
  Description of Artificial Sequence: Synthetic peptide
  TGF3 vhCDR1
SSSYSWG

SEQ ID NO: 543 - protein, 16 aa, Artificial Sequence
  Description of Artificial Sequence: Synthetic peptide
  TGF3 vhCDR2
SFYYSGITYYSPSLKS

SEQ ID NO: 544 - protein, 11 aa, Artificial Sequence
  Description of Artificial Sequence: Synthetic peptide
  TGF3 vhCDR3
GFTMIRGALDY

SEQ ID NO: 545 - protein, 107 aa, Artificial Sequence
  Description of Artificial Sequence: Synthetic polypeptide
  TGF3 Variable light (vl) domain
EIVLTQSPATLSLSPGERATLSCRASQSVRSFLAWYQQKPGQAPRLLIYDASNRATGIPARFSGSGSGTDFTLTISSLEPEDFAVYYCQQRSNWPPTFGQGTKVEIK

SEQ ID NO: 546 - protein, 11 aa, Artificial Sequence
  Description of Artificial Sequence: Synthetic peptide
  TGF3 vlCDR1
RASQSVRSFLA

SEQ ID NO: 547 - protein, 7 aa, Artificial Sequence
  Description of Artificial Sequence: Synthetic peptide
  TGF3 vlCDR2
DASNRAT

SEQ ID NO: 548 - protein, 9 aa, Artificial Sequence
  Description of Artificial Sequence: Synthetic peptide
  TGF3 vlCDR3
QQRSNWPPT

SEQ ID NO: 549 - protein, 116 aa, Artificial Sequence
  Description of Artificial Sequence: Synthetic polypeptide
  TR4C175 Variable heavy (vh) domain
EVQLVESGGGLVKPGGSLRLSCAASGFTFSSFSMNWVRQAPGKGLEWVSSISSSSSYIYYTDSVKGRFTISRDNAKNSLYLQMNSLRAEDTAVYYCARGYWGFDYWGQGTLVTVSS

SEQ ID NO: 550 - protein, 5 aa, Artificial Sequence
  Description of Artificial Sequence: Synthetic peptide
  TR4C175 vhCDR1
SFSMN

SEQ ID NO: 551 - protein, 17 aa, Artificial Sequence
  Description of Artificial Sequence: Synthetic peptide
  TR4C175 vhCDR2
SISSSSSYIYYTDSVKG

SEQ ID NO: 552 - protein, 7 aa, Artificial Sequence
  Description of Artificial Sequence: Synthetic peptide
  TR4C175 vhCDR3
GYWGFDY

SEQ ID NO: 553 - protein, 107 aa, Artificial Sequence
  Description of Artificial Sequence: Synthetic polypeptide
  TR4C175 Variable light (vl) domain
DIQMTQSPSSLSASVGDRVTITCRASQGIRNDLGWYQQKPGKAPKRLIYAASSLQSGVPSRFSGSASGTEFTLTISSLQPEDFATYYCLQHNSNPLTFGGGTKVEIK

SEQ ID NO: 554 - protein, 11 aa, Artificial Sequence
  Description of Artificial Sequence: Synthetic peptide
  TR4C175 vlCDR1
RASQGIRNDLG

SEQ ID NO: 555 - protein, 7 aa, Artificial Sequence
  Description of Artificial Sequence: Synthetic peptide
  TR4C175 vlCDR2
AASSLQS

SEQ ID NO: 556 - protein, 9 aa, Artificial Sequence
  Description of Artificial Sequence: Synthetic peptide
  TR4C175 vlCDR3
LQHNSNPLT

SEQ ID NO: 557 - protein, 117 aa, Artificial Sequence
  Description of Artificial Sequence: Synthetic polypeptide
  TR4D204 Variable heavy (vh) domain
GSVVQPGKSLRLSCAASGFTFSSYGMHWVRQAPGKGLEWVAVIWYDGSNKYYADSVKGRFTISRDNSKNTLYLQMNSLRAEDTAVYYCARGGIAVASGLYYYRMDVWGQGPRSTFSS

SEQ ID NO: 558 - protein, 5 aa, Artificial Sequence
  Description of Artificial Sequence: Synthetic peptide
  TR4D204 vhCDR1
SYGMH

SEQ ID NO: 559 - protein, 17 aa, Artificial Sequence
  Description of Artificial Sequence: Synthetic peptide
  TR4D204 vhCDR2
VIWYDGSNKYYADSVKG

SEQ ID NO: 560 - protein, 16 aa, Artificial Sequence
  Description of Artificial Sequence: Synthetic peptide
  TR4D204 vhCDR3
GGIAVASGLYYYRMDV

SEQ ID NO: 561 - protein, 107 aa, Artificial Sequence
  Description of Artificial Sequence: Synthetic polypeptide
  TR4D204 Variable light (vl) domain
DIVMTQSPDSLAVSLGERPPSTASPARVLYRSNNKNYLAWYQQKQDSLLSCSLLASTRKPGPDRFSGSGSGTDSLSPSAACRLMMWQLYCQQCYSAPVTSAEDSDIK

SEQ ID NO: 562 - protein, 115 aa, Artificial Sequence
  Description of Artificial Sequence: Synthetic polypeptide
  TR4D465 Variable heavy (vh) domain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREGMTTVTPTTTVWTSGA

SEQ ID NO: 563 - protein, 107 aa, Artificial Sequence
  Description of Artificial Sequence: Synthetic polypeptide
  TR4D465 Variable light (vl) domain
DIVMTQTHSLCRHPGQTAPSPASLVRASCLVMEDYMYWYLQKPGQPPHLLMYAVPNRFLECQIGSVAAGQDRFTLKISRVEAEGCWHYYCMQVYSSRTFGQGSSGIK

SEQ ID NO: 564 - protein, 120 aa, Artificial Sequence
  Description of Artificial Sequence: Synthetic polypeptide
  TR4D455 Variable heavy (vh) domain
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARVGGCSGGSCYLWGQGNLVTVSS

SEQ ID NO: 565 - protein, 5 aa, Artificial Sequence
  Description of Artificial Sequence: Synthetic peptide
  TR4D455 vhCDR1
SYWIG

SEQ ID NO: 566 - protein, 17 aa, Artificial Sequence
  Description of Artificial Sequence: Synthetic peptide
  TR4D455 vhCDR2
IIYPGDSDTRYSPSFQG

SEQ ID NO: 567 - protein, 11 aa, Artificial Sequence
  Description of Artificial Sequence: Synthetic peptide
  TR4D455 vhCDR3
VGGCSGGSCYL

SEQ ID NO: 568 - protein, 112 aa, Artificial Sequence
  Description of Artificial Sequence: Synthetic polypeptide
  TR4D455 Variable light (vl) domain
DVVMTQSPLSLPVTPGEPASISCRSSQSLLHSNGYNYLDWYLQKPGQSPQLLIFLGSNRASGVPDRFSGSGSGTDFTLKISRVEAEDVGVYFCMQVLPLPPTFGQGTRLEIK

SEQ ID NO: 569 - protein, 16 aa, Artificial Sequence
  Description of Artificial Sequence: Synthetic peptide
  TR4D455 vlCDR1
RSSQSLLHSNGYNYLD

SEQ ID NO: 570 - protein, 7 aa, Artificial Sequence
  Description of Artificial Sequence: Synthetic peptide
  TR4D455 vlCDR2
LGSNRAS

SEQ ID NO: 571 - protein, 9 aa, Artificial Sequence
  Description of Artificial Sequence: Synthetic peptide
  TR4D455 vlCDR3
MQVLPLPPT

SEQ ID NO: 572 - protein, 121 aa, Artificial Sequence; identical to SEQ ID NO: 525
  Description of Artificial Sequence: Synthetic polypeptide
  LY3022859 Variable heavy (vh) domain

SEQ ID NO: 573 - protein, 7 aa, Artificial Sequence
  Description of Artificial Sequence: Synthetic peptide
  LY3022859 vhCDR1
NSYFSWG

SEQ ID NO: 574 - protein, 16 aa, Artificial Sequence
  Description of Artificial Sequence: Synthetic peptide
  LY3022859 vhCDR2
SFYYGEKTYYNPSLKS

SEQ ID NO: 575 - protein, 11 aa, Artificial Sequence
  Description of Artificial Sequence: Synthetic peptide
  LY3022859 vhCDR3
GPTMIRGVIDS

SEQ ID NO: 576 - protein, 107 aa, Artificial Sequence; identical to SEQ ID NO: 529
  Description of Artificial Sequence: Synthetic polypeptide
  LY3022859 Variable light (vl) domain

SEQ ID NO: 577 - protein, 11 aa, Artificial Sequence
  Description of Artificial Sequence: Synthetic peptide
  LY3022859 vlCDR1
RASQSVRSYLA

SEQ ID NO: 578 - protein, 7 aa, Artificial Sequence
  Description of Artificial Sequence: Synthetic peptide
  LY3022859 vlCDR2
DASNRAT

SEQ ID NO: 579 - protein, 9 aa, Artificial Sequence
  Description of Artificial Sequence: Synthetic peptide
  LY3022859 vlCDR3
QQRSNWPPT

SEQ ID NO: 580 - protein, 111 aa, Artificial Sequence
  Description of Artificial Sequence: Synthetic polypeptide
  Autolus dAb 1 Variable heavy (vh) domain
QVQLQESGGGLVQAGGSLRLSCAASGIDLSTKSVAWYRQPPGKQREGVAHSSSGGTTIYADSVKGRFTISRDNSKNTVYLEMNSLKPEDTAVYYCTAPVGYWGQGTQVTVS

SEQ ID NO: 581 - protein, 5 aa, Artificial Sequence
  Description of Artificial Sequence: Synthetic peptide
  Autolus dAb 1 vhCDR1
TKSVA

SEQ ID NO: 582 - protein, 16 aa, Artificial Sequence
  Description of Artificial Sequence: Synthetic peptide
  Autolus dAb 1 vhCDR2
HSSSGGTTIYADSVKG

SEQ ID NO: 583 - protein, 4 aa, Artificial Sequence
  Description of Artificial Sequence: Synthetic peptide
  Autolus dAb 1 vhCDR3
PVGY

SEQ ID NO: 584 - protein, 111 aa, Artificial Sequence
  Description of Artificial Sequence: Synthetic polypeptide
  Autolus dAb 2 Variable heavy (vh) domain
QVQLQESGGGLVQPGGSLRLSCAASGIILSSKAVAWYRQPPGQQREGVAHSSVSGTTIYADSVKGRFTVSRDNAKNTVYLEMNSLKPEDTAVYYCTAPVGHWGQGTQVTVS

SEQ ID NO: 585 - protein, 5 aa, Artificial Sequence
  Description of Artificial Sequence: Synthetic peptide
  Autolus dAb 2 vhCDR1
SKAVA

SEQ ID NO: 586 - protein, 16 aa, Artificial Sequence
  Description of Artificial Sequence: Synthetic peptide
  Autolus dAb 2 vhCDR2
HSSVSGTTIYADSVKG

SEQ ID NO: 587 - protein, 4 aa, Artificial Sequence
  Description of Artificial Sequence: Synthetic peptide
  Autolus dAb 2 vhCDR3
PVGH

SEQ ID NO: 588 - protein, 111 aa, Artificial Sequence
  Description of Artificial Sequence: Synthetic polypeptide
  Autolus dAb 3 Variable heavy (vh) domain
QVQLQQSGGGLVQAGGSLRLSCAASGITFSTKPVAWYRQPPGKQREGVAHISSDGTTIYADSVKGRFTVSRDNAKNTVYLEMNSLKPEDTGVYYCTAPVGYWGQGTQVTVS

SEQ ID NO: 589 - protein, 5 aa, Artificial Sequence
  Description of Artificial Sequence: Synthetic peptide
  Autolus dAb 3 vhCDR1
TKPVA

SEQ ID NO: 590 - protein, 16 aa, Artificial Sequence
  Description of Artificial Sequence: Synthetic peptide
  Autolus dAb 3 vhCDR2
HISSDGTTIYADSVKG

SEQ ID NO: 591 - protein, 4 aa, Artificial Sequence
  Description of Artificial Sequence: Synthetic peptide
  Autolus dAb 3 vhCDR3
PVGY

SEQ ID NO: 592 - protein, 125 aa, Artificial Sequence
  Description of Artificial Sequence: Synthetic polypeptide
  Autolus dAb 4 Variable heavy (vh) domain
QVQLQQSGGGLVQAGGSLRLACAASGRSFSIYGITWFRQAPGKEREFVAAITGSGLTTNYADSVKGRFTISRDNAKNMVYLQLNSLKPDDTAVYYCAATRAYSGYYGENPTRYAYWGQGTQVTVS

SEQ ID NO: 593 - protein, 5 aa, Artificial Sequence
  Description of Artificial Sequence: Synthetic peptide
  Autolus dAb 4 vhCDR1
IYGIT

SEQ ID NO: 594 - protein, 17 aa, Artificial Sequence
  Description of Artificial Sequence: Synthetic peptide
  Autolus dAb 4 vhCDR2
AITGSGLTTNYADSVKG

SEQ ID NO: 595 - protein, 17 aa, Artificial Sequence
  Description of Artificial Sequence: Synthetic peptide
  Autolus dAb 4 vhCDR3
TRAYSGYYGENPTRYAY

SEQ ID NO: 596 - protein, 116 aa, Artificial Sequence
  Description of Artificial Sequence: Synthetic polypeptide
  DOM23h-33 Variable heavy (vh) domain
EVQLLESGGGLVQPGGSLRLSCAASGFTFSQYRMWWVRQAPGKGLEWVSAIAPSGDNTYYADSVKGRFTISRDNSKNTLYLQMNSLRAEDTAVYYCAKHRTSFDYWGQGTLVTVSS

SEQ ID NO: 597 - protein, 5 aa, Artificial Sequence
  Description of Artificial Sequence: Synthetic peptide
  DOM23h-33 vhCDR1
QYRMW

SEQ ID NO: 598 - protein, 17 aa, Artificial Sequence
  Description of Artificial Sequence: Synthetic peptide
  DOM23h-33 vhCDR2
AIAPSGDNTYYADSVKG

SEQ ID NO: 599 - protein, 7 aa, Artificial Sequence
  Description of Artificial Sequence: Synthetic peptide
  DOM23h-33 vhCDR3
HRTSFDY

SEQ ID NO: 600 - protein, 116 aa, Artificial Sequence
  Description of Artificial Sequence: Synthetic polypeptide
  DOM23h-251 Variable heavy (vh) domain
EVQLLESGGGLVQPGGSLRLSCAASGFTFSDYDMWWVRQAPGKGLEWVSKITQKGDFTYYADSVKGRFTISRDNSKNTLYLQMNSLRAEDTAVYYCAKDATHFDYWGQGTLVTVSS

SEQ ID NO: 601 - protein, 5 aa, Artificial Sequence
  Description of Artificial Sequence: Synthetic peptide
  DOM23h-251 vhCDR1
DYDMW

SEQ ID NO: 602 - protein, 17 aa, Artificial Sequence
  Description of Artificial Sequence: Synthetic peptide
  DOM23h-251 vhCDR2
KITQKGDFTYYADSVKG

SEQ ID NO: 603 - protein, 7 aa, Artificial Sequence
  Description of Artificial Sequence: Synthetic peptide
  DOM23h-251 vhCDR3
DATHFDY

SEQ ID NO: 604 - protein, 124 aa, Artificial Sequence
  Description of Artificial Sequence: Synthetic polypeptide
  DOM23h-262 Variable heavy (vh) domain
EVQLLESGGGLVQPGGSLRLSCAASGFTFFNYEMAWARQAPGKGLEWVSLISAEGTRTYYADSVKGRFTISRDNSKNTLYLQMNSLRAEDTAVYYCAKRRDASMGHTTRRFDYWGQGTLVTVSS

SEQ ID NO: 605 - protein, 5 aa, Artificial Sequence
  Description of Artificial Sequence: Synthetic peptide
  DOM23h-262 vhCDR1
NYEMA

SEQ ID NO: 606 - protein, 17 aa, Artificial Sequence
  Description of Artificial Sequence: Synthetic peptide
  DOM23h-262 vhCDR2
LISAEGTRTYYADSVKG

SEQ ID NO: 607 - protein, 15 aa, Artificial Sequence
  Description of Artificial Sequence: Synthetic peptide
  DOM23h-262 vhCDR3
RRDASMGHTTRRFDY

SEQ ID NO: 608 - protein, 124 aa, Artificial Sequence
  Description of Artificial Sequence: Synthetic polypeptide
  DOM23h-271 Variable heavy (vh) domain
EVQLLESGGGLVQPGGSLRLSCAASGFTFTEYRMWWVRQAPGKGLEWVSSIEPIGNRTYYADSVKGRFTISRDNSKNTLYLQMNSLRAEDTAVYYCAKQIPGHKWTANSRFDYWGQGTLVTVSS

SEQ ID NO: 609 - protein, 5 aa, Artificial Sequence
  Description of Artificial Sequence: Synthetic peptide
  DOM23h-271 vhCDR1
EYRMW

SEQ ID NO: 610 - protein, 17 aa, Artificial Sequence
  Description of Artificial Sequence: Synthetic peptide
  DOM23h-271 vhCDR2
SIEPIGNRTYYADSVKG

SEQ ID NO: 611 - protein, 15 aa, Artificial Sequence
  Description of Artificial Sequence: Synthetic peptide
  DOM23h-271 vhCDR3
QIPGHKWTANSRFDY

SEQ ID NO: 612 - protein, 121 aa, Artificial Sequence
  Description of Artificial Sequence: Synthetic polypeptide
  DOM23h-348 Variable heavy (vh) domain
EVQLLESGGGLVQPGGSLRLSCAASGFTFSDYDMAWARQAPGKGLEWVSRISHSGYSTYYADSVKGRFTISRDNSKNTLYLQMNSLRAEDTAVYYCAKRSWDGVHAQFDYWGQGTLVTVSS

SEQ ID NO: 613 - protein, 5 aa, Artificial Sequence
  Description of Artificial Sequence: Synthetic peptide
  DOM23h-348 vhCDR1
DYDMA

SEQ ID NO: 614 - protein, 17 aa, Artificial Sequence
  Description of Artificial Sequence: Synthetic peptide
  DOM23h-348 vhCDR2
RISHSGYSTYYADSVKG

SEQ ID NO: 615 - protein, 12 aa, Artificial Sequence
  Description of Artificial Sequence: Synthetic peptide
  DOM23h-348 vhCDR3
RSWDGVHAQFDY

SEQ ID NO: 616 - protein, 116 aa, Artificial Sequence
  Description of Artificial Sequence: Synthetic polypeptide
  DOM23h-435 Variable heavy (vh) domain
EVQLLESGGGLVQPGGSLRLTCAASGFTFTDDRMWWVRQAPGKGLEWVSAIDPQGQHTYYADSVKGRFTISRDNSKNTLYLQMNSLRAEDTAVYYCAKHNSSFDYWGQGTLVTVSS

SEQ ID NO: 617 - protein, 5 aa, Artificial Sequence
  Description of Artificial Sequence: Synthetic peptide
  DOM23h-435 vhCDR1
DDRMW

SEQ ID NO: 618 - protein, 17 aa, Artificial Sequence
  Description of Artificial Sequence: Synthetic peptide
  DOM23h-435 vhCDR2
AIDPQGQHTYYADSVKG

SEQ ID NO: 619 - protein, 7 aa, Artificial Sequence
  Description of Artificial Sequence: Synthetic peptide
  DOM23h-435 vhCDR3
HNSSFDY

SEQ ID NO: 620 - protein, 116 aa, Artificial Sequence
  Description of Artificial Sequence: Synthetic polypeptide
  DOM23h-436 Variable heavy (vh) domain
EVQLLESGGGLVQPGGSLRLSCAASGFTFSDYKMGWVRQAPGKGLEWVSSIWPNGGLTYYADSVKGRFTISRDNSKNTLYLQMNSLRAEDTAVYYCAKDHMGFDYWGQGTLVTVSS

SEQ ID NO: 621 - protein, 5 aa, Artificial Sequence
  Description of Artificial Sequence: Synthetic peptide
  DOM23h-436 vhCDR1
DYKMG

SEQ ID NO: 622 - protein, 17 aa, Artificial Sequence
  Description of Artificial Sequence: Synthetic peptide
  DOM23h-436 vhCDR2
SIWPNGGLTYYADSVKG

SEQ ID NO: 623 - protein, 7 aa, Artificial Sequence
  Description of Artificial Sequence: Synthetic peptide
  DOM23h-436 vhCDR3
DHMGFDY

SEQ ID NO: 624 - protein, 116 aa, Artificial Sequence
  Description of Artificial Sequence: Synthetic polypeptide
  DOM23h-437 Variable heavy (vh) domain
EVQLLESGGGLVQPGGSLRLSCAASGFTFSDYRMWWVRQAPGKGLEWVSAIDSQGHTTYYADSVKGRFTISRDNSKNTLYLQMNSLRAEDTAVYYCAKYGGYFDYWGQGTLVTVSS

SEQ ID NO: 625 - protein, 5 aa, Artificial Sequence
  Description of Artificial Sequence: Synthetic peptide
  DOM23h-437 vhCDR1
DYRMW

SEQ ID NO: 626 - protein, 17 aa, Artificial Sequence
  Description of Artificial Sequence: Synthetic peptide
  DOM23h-437 vhCDR2
AIDSQGHTTYYADSVKG

SEQ ID NO: 627 - protein, 7 aa, Artificial Sequence
  Description of Artificial Sequence: Synthetic peptide
  DOM23h-437 vhCDR3
YGGYFDY

SEQ ID NO: 628 - protein, 119 aa, Artificial Sequence
  Description of Artificial Sequence: Synthetic polypeptide
  DOM23h-438 Variable heavy (vh) domain
EVQLLESGGGLVQPGGSLRLSCAASGFTFAQGDMWWVRQAPGKGLEWVSRIGMDGDKTYYADSVKGRFTISRDNSKNTLYLQMNSLRAEDTAVYYCAKGPSSTSPFDYWGQGTLVTVSS

SEQ ID NO: 629 - protein, 5 aa, Artificial Sequence
  Description of Artificial Sequence: Synthetic peptide
  DOM23h-438 vhCDR1
QGDMW

SEQ ID NO: 630 - protein, 17 aa, Artificial Sequence
  Description of Artificial Sequence: Synthetic peptide
  DOM23h-438 vhCDR2
RIGMDGDKTYYADSVKG

SEQ ID NO: 631 - protein, 10 aa, Artificial Sequence
  Description of Artificial Sequence: Synthetic peptide
  DOM23h-438 vhCDR3
GPSSTSPFDY

SEQ ID NO: 632 - protein, 122 aa, Artificial Sequence
  Description of Artificial Sequence: Synthetic polypeptide
  DOM23h-439 Variable heavy (vh) domain
EVQLLESGGGLVQPGGSLRLSCAASGFTFGTEQMWWVRQAPGKGLEWVSRIDSPGGRTYYADSVKGRFTISRDNSKNTLYLQMNSLRAEDTAVYYCAKRHAAGVSGTYFDYWGQGTLVTVSS

SEQ ID NO: 633 - protein, 5 aa, Artificial Sequence
  Description of Artificial Sequence: Synthetic peptide
  DOM23h-439 vhCDR1
TEQMW

SEQ ID NO: 634 - protein, 17 aa, Artificial Sequence
  Description of Artificial Sequence: Synthetic peptide
  DOM23h-439 vhCDR2
RIDSPGGRTYYADSVKG

SEQ ID NO: 635 - protein, 13 aa, Artificial Sequence
  Description of Artificial Sequence: Synthetic peptide
  DOM23h-439 vhCDR3
RHAAGVSGTYFDY

SEQ ID NO: 636 - protein, 116 aa, Artificial Sequence
  Description of Artificial Sequence: Synthetic polypeptide
  DOM23h-440 Variable heavy (vh) domain
EVQLLESGGGLVQPGGSLRLSCAASGFTFTDDRMWWVRQAPGKGLEWVSAIDPQGQHTYYADSVKGRFTISRDNSKNTLYLQMNSLRAEDTAVYYCAKELLSFDYWGQGTLVTVSS

SEQ ID NO: 637 - protein, 5 aa, Artificial Sequence
  Description of Artificial Sequence: Synthetic peptide
  DOM23h-440 vhCDR1
DDRMW

SEQ ID NO: 638 - protein, 17 aa, Artificial Sequence
  Description of Artificial Sequence: Synthetic peptide
  DOM23h-440 vhCDR2
AIDPQGQHTYYADSVKG

SEQ ID NO: 639 - protein, 7 aa, Artificial Sequence
  Description of Artificial Sequence: Synthetic peptide
  DOM23h-440 vhCDR3
ELLSFDY

SEQ ID NO: 640 - protein, 124 aa, Artificial Sequence
  Description of Artificial Sequence: Synthetic polypeptide
  DOM23h-262-6 Variable heavy (vh) domain
EVQLLESGGGLVQPGGSLRLSCAASGFTFFNYEMAWARQAPGKGLEWVSLISAEGTRTYYANSVKGRFTISRDNSKNTLYLQMNSLRAEDTAVYYCAKRRDASMGHTTRRFDHWGQGTLVTVSS

SEQ ID NO: 641 - protein, 5 aa, Artificial Sequence
  Description of Artificial Sequence: Synthetic peptide
  DOM23h-262-6 vhCDR1
NYEMA

SEQ ID NO: 642 - protein, 17 aa, Artificial Sequence
  Description of Artificial Sequence: Synthetic peptide
  DOM23h-262-6 vhCDR2
LISAEGTRTYYANSVKG

SEQ ID NO: 643 - protein, 15 aa, Artificial Sequence
  Description of Artificial Sequence: Synthetic peptide
  DOM23h-262-6 vhCDR3
RRDASMGHTTRRFDH

SEQ ID NO: 644 - protein, 124 aa, Artificial Sequence
  Description of Artificial Sequence: Synthetic polypeptide
  DOM23h-262-10 Variable heavy (vh) domain
EVQLLESGGGLVQPGGSLRLSCAASGFTFFNYEMAWARRAPGKGLEWVSLISADGTRTYYANSVRGRFTISRDNSKNTLYLQMNSLRAEDTAVYYCAKRRDASMGHTTRRFDYSGQGTLVTVSS

SEQ ID NO: 645 - protein, 5 aa, Artificial Sequence
  Description of Artificial Sequence: Synthetic peptide
  DOM23h-262-10 vhCDR1
NYEMA

SEQ ID NO: 646 - protein, 17 aa, Artificial Sequence
  Description of Artificial Sequence: Synthetic peptide
  DOM23h-262-10 vhCDR2
LISADGTRTYYANSVRG

SEQ ID NO: 647 - protein, 15 aa, Artificial Sequence
  Description of Artificial Sequence: Synthetic peptide
  DOM23h-262-10 vhCDR3
RRDASMGHTTRRFDY

SEQ ID NO: 648 - protein, 124 aa, Artificial Sequence
  Description of Artificial Sequence: Synthetic polypeptide
  DOM23h-271-3 Variable heavy (vh) domain
EVQLLESGGGLVQPGGSLRLSCTASGFTFTEYRMWWVRQAPGKGLEWVSLIEPIGNRTYYADSVKGRFTISRDNSKNTLYLQMNSLRAEDTAVYYCAKQIPGHMWTANPRSDYWGQGTQVTVSS

SEQ ID NO: 649 - protein, 5 aa, Artificial Sequence
  Description of Artificial Sequence: Synthetic peptide
  DOM23h-271-3 vhCDR1
EYRMW

SEQ ID NO: 650 - protein, 17 aa, Artificial Sequence
  Description of Artificial Sequence: Synthetic peptide
  DOM23h-271-3 vhCDR2
LIEPIGNRTYYADSVKG

SEQ ID NO: 651 - protein, 15 aa, Artificial Sequence
  Description of Artificial Sequence: Synthetic peptide
  DOM23h-271-3 vhCDR3
QIPGHMWTANPRSDY

SEQ ID NO: 652 - protein, 124 aa, Artificial Sequence
  Description of Artificial Sequence: Synthetic polypeptide
  DOM23h-271-7 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQIPGRKWTANSRFDYWGQGTLVTVSS

SEQ ID NO: 653 - protein, 5 aa, Artificial Sequence
  Description of Artificial Sequence: Synthetic peptide
  DOM23h-271-7 vhCDR1
EYRMW

SEQ ID NO: 654 - protein, 17 aa, Artificial Sequence
  Description of Artificial Sequence: Synthetic peptide
  DOM23h-271-7 vhCDR2
AIEPIGNRTYYADSVKG

SEQ ID NO: 655 - protein, 15 aa, Artificial Sequence
  Description of Artificial Sequence: Synthetic peptide
  DOM23h-271-7 vhCDR3
QIPGRKWTANSRFDY

SEQ ID NO: 656 - protein, 124 aa, Artificial Sequence
  Description of Artificial Sequence: Synthetic polypeptide
  DOM23h-271-12 Variable heavy (vh) domain
EVQLLESGGGLVQPGGSLRLSCTASGFTFTEYRMWWVRQAPGKGLEWVSLIEPIGNRTYYANSVRGRFTISRDNSKNTLYLQMNSLRAEDTAVYYCAKQIPGHMWTANPRSDYWGQGTQVTVSS

SEQ ID NO: 657 - protein, 5 aa, Artificial Sequence
  Description of Artificial Sequence: Synthetic peptide
  DOM23h-271-12 vhCDR1
EYRMW

SEQ ID NO: 658 - protein, 17 aa, Artificial Sequence
  Description of Artificial Sequence: Synthetic peptide
  DOM23h-271-12 vhCDR2
LIEPIGNRTYYANSVRG

SEQ ID NO: 659 - protein, 15 aa, Artificial Sequence
  Description of Artificial Sequence: Synthetic peptide
  DOM23h-271-12 vhCDR3
QIPGHMWTANPRSDY

SEQ ID NO: 660 - protein, 124 aa, Artificial Sequence
  Description of Artificial Sequence: Synthetic polypeptide
  DOM23h-271-13 Variable heavy (vh) domain
EVQLLESGGGLVQPGGSLRLSCAASGFTFTEYRMWWVRQAPGKGLEWVSAIEPIGNRTYYANSVRGRFTISRDNSKNTLYLQMNSLRAEDTAVYYCAKQIPGRKWTANSRFDYWGQGTLVTVSS

SEQ ID NO: 661 - protein, 5 aa, Artificial Sequence
  Description of Artificial Sequence: Synthetic peptide
  DOM23h-271-13 vhCDR1
EYRMW

SEQ ID NO: 662 - protein, 17 aa, Artificial Sequence
  Description of Artificial Sequence: Synthetic peptide
  DOM23h-271-13 vhCDR2
AIEPIGNRTYYANSVRG

SEQ ID NO: 663 - protein, 15 aa, Artificial Sequence
  Description of Artificial Sequence: Synthetic peptide
  DOM23h-271-13 vhCDR3
QIPGRKWTANSRFDY

SEQ ID NO: 664 - protein, 116 aa, Artificial Sequence
  Description of Artificial Sequence: Synthetic polypeptide
  DOM23h-437-4 Variable heavy (vh) domain
EVQLLESGGGLVQPGGSLRLSCAASGFTISDYRMWWVRQAPGKGLEWVSAIDSQGHTTYYADSVRGRFTISRDNSKNTLYLQMNSLRAEDTAVYYCAKYGGYFDYWGQGTLVTVSS

SEQ ID NO: 665 - protein, 5 aa, Artificial Sequence
  Description of Artificial Sequence: Synthetic peptide
  DOM23h-437-4 vhCDR1
DYRMW

SEQ ID NO: 666 - protein, 17 aa, Artificial Sequence
  Description of Artificial Sequence: Synthetic peptide
  DOM23h-437-4 vhCDR2
AIDSQGHTTYYADSVRG

SEQ ID NO: 667 - protein, 7 aa, Artificial Sequence
  Description of Artificial Sequence: Synthetic peptide
  DOM23h-437-4 vhCDR3
YGGYFDY

SEQ ID NO: 668 - protein, 116 aa, Artificial Sequence
  Description of Artificial Sequence: Synthetic polypeptide
  DOM23h-437-6 Variable heavy (vh) domain
EVQLLESGGGLVQPGGSLRLSCATSGFTFSDYRMWWVRQAPGKGLEWVSAIDSQGHTTYYADSVKGRFTISRDNSKNTLYLQMNSLRAEDTAVYYCAKYGGYFDYWGQGTLVTVSS

SEQ ID NO: 669 - protein, 5 aa, Artificial Sequence
  Description of Artificial Sequence: Synthetic peptide
  DOM23h-437-6 vhCDR1
DYRMW

SEQ ID NO: 670 - protein, 17 aa, Artificial Sequence
  Description of Artificial Sequence: Synthetic peptide
  DOM23h-437-6 vhCDR2
AIDSQGHTTYYADSVKG

SEQ ID NO: 671 - protein, 7 aa, Artificial Sequence
  Description of Artificial Sequence: Synthetic peptide
  DOM23h-437-6 vhCDR3
YGGYFDY

SEQ ID NO: 672 - protein, 116 aa, Artificial Sequence
  Description of Artificial Sequence: Synthetic polypeptide
  DOM23h-437-8 Variable heavy (vh) domain
EVQLLESGGGLVQPGGSLRLSCAASGFTISDYRMWWVRQAPGKGLEWVSAIDSQGHTTYYANSVRGRFTISRDNSKNTLYLQMNSLRAEDTAVYYCAKYGGYFDYWGQGTLVTVSS

SEQ ID NO: 673 - protein, 5 aa, Artificial Sequence
  Description of Artificial Sequence: Synthetic peptide
  DOM23h-437-8 vhCDR1
DYRMW

SEQ ID NO: 674 - protein, 17 aa, Artificial Sequence
  Description of Artificial Sequence: Synthetic peptide
  DOM23h-437-8 vhCDR2
AIDSQGHTTYYANSVRG

SEQ ID NO: 675 - protein, 7 aa, Artificial Sequence
  Description of Artificial Sequence: Synthetic peptide
  DOM23h-437-8 vhCDR3
YGGYFDY

SEQ ID NO: 676 - protein, 116 aa, Artificial Sequence
  Description of Artificial Sequence: Synthetic polypeptide
  DOM23h-437-9 Variable heavy (vh) domain
EVQLLESGGGLVQPGGSLRLSCATSGFTFSDYRMWWVRQAPGKGLEWVSAIDSQGHTTYYANSVRGRFTISRDNSKNTLYLQMNSLRAEDTAVYYCAKYGGYFDYWGQGTLVTVSS

SEQ ID NO: 677 - protein, 5 aa, Artificial Sequence
  Description of Artificial Sequence: Synthetic peptide
  DOM23h-437-9 vhCDR1
DYRMW

SEQ ID NO: 678 - protein, 17 aa, Artificial Sequence
  Description of Artificial Sequence: Synthetic peptide
  DOM23h-437-9 vhCDR2
AIDSQGHTTYYANSVRG

SEQ ID NO: 679 - protein, 7 aa, Artificial Sequence
  Description of Artificial Sequence: Synthetic peptide
  DOM23h-437-9 vhCDR3
YGGYFDY

SEQ ID NO: 680 - protein, 122 aa, Artificial Sequence
  Description of Artificial Sequence: Synthetic polypeptide
  DOM23h-439-6 Variable heavy (vh) domain
EVQLLESGGGLVRPGGSLRLSCAASGFTFGTEQMWWVRQAPGKGLEWVSRIDSPGGRTYYADSVRGRFTISRDNSKNTLYLQMNSLRAEDTAVYYCAKRHAAGVSGTYFDYWGQGTLVTVSS

SEQ ID NO: 681 - protein, 5 aa, Artificial Sequence
  Description of Artificial Sequence: Synthetic peptide
  DOM23h-439-6 vhCDR1
TEQMW

SEQ ID NO: 682 - protein, 17 aa, Artificial Sequence
  Description of Artificial Sequence: Synthetic peptide
  DOM23h-439-6 vhCDR2
RIDSPGGRTYYADSVRG

SEQ ID NO: 683 - protein, 13 aa, Artificial Sequence
  Description of Artificial Sequence: Synthetic peptide
  DOM23h-439-6 vhCDR3
RHAAGVSGTYFDY

SEQ ID NO: 684 - protein, 122 aa, Artificial Sequence
  Description of Artificial Sequence: Synthetic polypeptide
  DOM23h-439-8 Variable heavy (vh) domain
EVQLLESGGGLVRPGGSLRLSCAASGFTFGTEQMWWVRQAPGKGLEWVSRIDSPGGRTYYANSVRGRFTISRDNSKNTLYLQMNSLRAEDTAVYYCAKRHAAGVSGTYFDYWGQGTLVTVSS

SEQ ID NO: 685 - protein, 5 aa, Artificial Sequence
  Description of Artificial Sequence: Synthetic peptide
  DOM23h-439-8 vhCDR1
TEQMW

SEQ ID NO: 686 - protein, 17 aa, Artificial Sequence
  Description of Artificial Sequence: Synthetic peptide
  DOM23h-439-8 vhCDR2
RIDSPGGRTYYANSVRG

SEQ ID NO: 687 - protein, 13 aa, Artificial Sequence
  Description of Artificial Sequence: Synthetic peptide
  DOM23h-439-8 vhCDR3
RHAAGVSGTYFDY

SEQ ID NO: 688 - protein, 119 aa, Artificial Sequence
  Description of Artificial Sequence: Synthetic polypeptide
  DOM23h-802 Variable heavy (vh) domain
EVQLLESGGGLVQPGGSLRLSCAASGFTFSEGTMWWVRQAPGKGLEWVSAILAAGSNTYYADSVKGRFTISRDNSKNTLYLQMNSLRAEDTAVYYCAKKRQERDGFDYWGQGTLVTVSS

SEQ ID NO: 689 - protein, 5 aa, Artificial Sequence
  Description of Artificial Sequence: Synthetic peptide
  DOM23h-802 vhCDR1
EGTMW

SEQ ID NO: 690 - protein, 17 aa, Artificial Sequence
  Description of Artificial Sequence: Synthetic peptide
  DOM23h-802 vhCDR2
AILAAGSNTYYADSVKG

SEQ ID NO: 691 - protein, 10 aa, Artificial Sequence
  Description of Artificial Sequence: Synthetic peptide
  DOM23h-802 vhCDR3
KRQERDGFDY

SEQ ID NO: 692 - protein, 119 aa, Artificial Sequence
  Description of Artificial Sequence: Synthetic polypeptide
  DOM23h-803 Variable heavy (vh) domain
EVQLLESGGGLVQPGGSLRLSCAASGFTFSAGRMWWVRQAPGKGLEWVSAINRDGTRTYYADSVKGRFTISRDNSKNTLYLQMNSLRAEDTAVYYCAKHDDGHGNFDYWGQGTLVTVSS

SEQ ID NO: 693 - protein, 5 aa, Artificial Sequence
  Description of Artificial Sequence: Synthetic peptide
  DOM23h-803 vhCDR1
AGRMW

SEQ ID NO: 694 - protein, 17 aa, Artificial Sequence
  Description of Artificial Sequence: Synthetic peptide
  DOM23h-803 vhCDR2
AINRDGTRTYYADSVKG

SEQ ID NO: 695 - protein, 10 aa, Artificial Sequence
  Description of Artificial Sequence: Synthetic peptide
  DOM23h-803 vhCDR3
HDDGHGNFDY

SEQ ID NO: 696 - protein, 120 aa, Artificial Sequence
  Description of Artificial Sequence: Synthetic polypeptide
  DOM23h-813 Variable heavy (vh) domain
EVQLLESGGGLVQPGGSLRLSCAASGSTFTDDRMWWVRQAPGKGLEWVSAIQPDGHTTYYADSVKGRFTISRDNSKNTLYLQMNSLRAEDTAVYYCAEQDVKGSSSFDYWGQGTLVTVSS

SEQ ID NO: 697 - protein, 5 aa, Artificial Sequence
  Description of Artificial Sequence: Synthetic peptide
  DOM23h-813 vhCDR1
DDRMW

SEQ ID NO: 698 - protein, 17 aa, Artificial Sequence
  Description of Artificial Sequence: Synthetic peptide
  DOM23h-813 vhCDR2
AIQPDGHTTYYADSVKG

SEQ ID NO: 699 - protein, 11 aa, Artificial Sequence
  Description of Artificial Sequence: Synthetic peptide
  DOM23h-813 vhCDR3
QDVKGSSSFDY

SEQ ID NO: 700 - protein, 119 aa, Artificial Sequence
  Description of Artificial Sequence: Synthetic polypeptide
  DOM23h-815 Variable heavy (vh) domain
EVQLLESGGGLVQPGGSLRLSCAASGFTFAEDRMWWVRQAPGKGLEWVSAIDPQGQHTYYADSVKGRFTISRDNSKNTLYLQMNSLRAEDTAVYYCAKQSTGSATSDYWGQGTLVTVSS

SEQ ID NO: 701 - protein, 5 aa, Artificial Sequence
  Description of Artificial Sequence: Synthetic peptide
  DOM23h-815 vhCDR1
EDRMW

SEQ ID NO: 702 - protein, 17 aa, Artificial Sequence
  Description of Artificial Sequence: Synthetic peptide
  DOM23h-815 vhCDR2
AIDPQGQHTYYADSVKG

SEQ ID NO: 703 - protein, 10 aa, Artificial Sequence
  Description of Artificial Sequence: Synthetic peptide
  DOM23h-815 vhCDR3
QSTGSATSDY

SEQ ID NO: 704 - protein, 124 aa, Artificial Sequence
  Description of Artificial Sequence: Synthetic polypeptide
  DOM23h-828 Variable heavy (vh) domain
EVQLLESGGGLVQPGGSLRLSCAASGFTFMSYRMWWVRQAPGKGLEWVSAISPSGSDTYYADSVKGRFTISRDNSKNTLYLQMNSLRAEDTAVYYCAKQVVEYSRTHKGVFDYWGQGTLVTVSS

SEQ ID NO: 705 - protein, 5 aa, Artificial Sequence
  Description of Artificial Sequence: Synthetic peptide
  DOM23h-828 vhCDR1
SYRMW

SEQ ID NO: 706 - protein, 17 aa, Artificial Sequence
  Description of Artificial Sequence: Synthetic peptide
  DOM23h-828 vhCDR2
AISPSGSDTYYADSVKG

SEQ ID NO: 707 - protein, 15 aa, Artificial Sequence
  Description of Artificial Sequence: Synthetic peptide
  DOM23h-828 vhCDR3
QVVEYSRTHKGVFDY

SEQ ID NO: 708 - protein, 122 aa, Artificial Sequence
  Description of Artificial Sequence: Synthetic polypeptide
  DOM23h-830 Variable heavy (vh) domain
EVQLLESGGGLVQPGGFLRLSCAASGFTFEGYRMWWVRQAPGKGLEWVSAIDSLGDRTYYADSVKGRFTISRDNSKNTLYLQMNSLRAEDTAVYYCAKQGLTHQSPSTFDYWGQGTLVTVSS

SEQ ID NO: 709 - protein, 5 aa, Artificial Sequence
  Description of Artificial Sequence: Synthetic peptide
  DOM23h-830 vhCDR1
GYRMW

SEQ ID NO: 710 - protein, 17 aa, Artificial Sequence
  Description of Artificial Sequence: Synthetic peptide
  DOM23h-830 vhCDR2
AIDSLGDRTYYADSVKG

SEQ ID NO: 711 - protein, 13 aa, Artificial Sequence
  Description of Artificial Sequence: Synthetic peptide
  DOM23h-830 vhCDR3
QGLTHQSPSTFDY

SEQ ID NO: 712 - protein, 116 aa, Artificial Sequence
  Description of Artificial Sequence: Synthetic polypeptide
  DOM23h-831 Variable heavy (vh) domain
EVQLLESGGGLVQPGGSLRLSCAASGFTFEAYKMTWVRQAPGKGLEWVSYITPSGGQTYYADSVKGRFTISRDNSKNTLYLQMNSLRAEDTAVYYCAKYGSSFDYWGQGTLVTVSS

SEQ ID NO: 713 - protein, 5 aa, Artificial Sequence
  Description of Artificial Sequence: Synthetic peptide
  DOM23h-831 vhCDR1
AYKMT

SEQ ID NO: 714 - protein, 17 aa, Artificial Sequence
  Description of Artificial Sequence: Synthetic peptide
  DOM23h-831 vhCDR2
YITPSGGQTYYADSVKG

SEQ ID NO: 715 - protein, 7 aa, Artificial Sequence
  Description of Artificial Sequence: Synthetic peptide
  DOM23h-831 vhCDR3
YGSSFDY

SEQ ID NO: 716 - protein, 119 aa, Artificial Sequence
  Description of Artificial Sequence: Synthetic polypeptide
  DOM23h-840 Variable heavy (vh) domain
EVQLLESGGGLVQPGGSLRLSCAASGFTFGDGRMWWVRQAPGKGLEWVSAIEGAGSDTYYADSVKGRFTISRDNSKNTLYLQMNSLRAEDTAVYYCAKQASRNSPFDYWGQGTLVTVSS

SEQ ID NO: 717 - protein, 5 aa, Artificial Sequence
  Description of Artificial Sequence: Synthetic peptide
  DOM23h-840 vhCDR1
DGRMW

SEQ ID NO: 718 - protein, 17 aa, Artificial Sequence
  Description of Artificial Sequence: Synthetic peptide
  DOM23h-840 vhCDR2
AIEGAGSDTYYADSVKG

SEQ ID NO: 719 - protein, 10 aa, Artificial Sequence
  Description of Artificial Sequence: Synthetic peptide
  DOM23h-840 vhCDR3
QASRNSPFDY

SEQ ID NO: 720 - protein, 120 aa, Artificial Sequence
  Description of Artificial Sequence: Synthetic polypeptide
  DOM23h-842 Variable heavy (vh) domain
EVQLLESGGGLVQPGGSLRLSCAASGFTFDDSEMAWARQAPGKGLEWVSLIRRNGNATYYADSVKGRFTISRDNSKNTLYLQMNSLRAEDTAVYYCAKVTKDRSVLFDYWGQGTLVTVSS

SEQ ID NO: 721 - protein, 5 aa, Artificial Sequence
  Description of Artificial Sequence: Synthetic peptide
  DOM23h-842 vhCDR1
DSEMA

SEQ ID NO: 722 - protein, 17 aa, Artificial Sequence
  Description of Artificial Sequence: Synthetic peptide
  DOM23h-842 vhCDR2
LIRRNGNATYYADSVKG

SEQ ID NO: 723 - protein, 11 aa, Artificial Sequence
  Description of Artificial Sequence: Synthetic peptide
  DOM23h-842 vhCDR3
VTKDRSVLFDY

SEQ ID NO: 724 - protein, 120 aa, Artificial Sequence
  Description of Artificial Sequence: Synthetic polypeptide
  DOM23h-843 Variable heavy (vh) domain
EVQLLESGGGLVQPGGSLRLSCAASGFTFDQDRMWWVRQAPGKGLEWVSAIESGGHRTYYADSVKGRFTISRDNSKNTLYLQMNSLRAEDTAVYYCAKQNESGRSGFDYWGQGTLVTVSS

SEQ ID NO: 725 - protein, 5 aa, Artificial Sequence
  Description of Artificial Sequence: Synthetic peptide
  DOM23h-843 vhCDR1
QDRMW

SEQ ID NO: 726 - protein, 17 aa, Artificial Sequence
  Description of Artificial Sequence: Synthetic peptide
  DOM23h-843 vhCDR2
AIESGGHRTYYADSVKG

SEQ ID NO: 727 - protein, 11 aa, Artificial Sequence
  Description of Artificial Sequence: Synthetic peptide
  DOM23h-843 vhCDR3
QNESGRSGFDY

SEQ ID NO: 728 - protein, 119 aa, Artificial Sequence
  Description of Artificial Sequence: Synthetic polypeptide
  DOM23h-850 Variable heavy (vh) domain
EVQLLESGGGLVQPGGSLRLSCAASGFTFDAARMWWARQAPGKGLEWVSAIADIGNTTYYADSVKGRFTISRDNSKNTLYLQMNSLRAEDTAVYYCAKQSGSEDHFDYWGQGTLVTVSS

SEQ ID NO: 729 - protein, 5 aa, Artificial Sequence
  Description of Artificial Sequence: Synthetic peptide
  DOM23h-850 vhCDR1
AARMW

SEQ ID NO: 730 - protein, 17 aa, Artificial Sequence
  Description of Artificial Sequence: Synthetic peptide
  DOM23h-850 vhCDR2
AIADIGNTTYYADSVKG

SEQ ID NO: 731 - protein, 10 aa, Artificial Sequence
  Description of Artificial Sequence: Synthetic peptide
  DOM23h-850 vhCDR3
QSGSEDHFDY

SEQ ID NO: 732 - protein, 121 aa, Artificial Sequence
  Description of Artificial Sequence: Synthetic polypeptide
  DOM23h-854 Variable heavy (vh) domain
EVQLLESGGGLVQPGGSLRLSCAASGFTFAQDRMWWVRQAPGKGLEWVSAISGSGGSTYYADSVKGRFTISRDNSKNTLYLQMNSLRAEDTAVYYCAKQDLHGTSSLFDYWGQGTLVTVSS

SEQ ID NO: 733 - protein, 5 aa, Artificial Sequence
  Description of Artificial Sequence: Synthetic peptide
  DOM23h-854 vhCDR1
QDRMW

SEQ ID NO: 734 - protein, 17 aa, Artificial Sequence
  Description of Artificial Sequence: Synthetic peptide
  DOM23h-854 vhCDR2
AISGSGGSTYYADSVKG

SEQ ID NO: 735 - protein, 12 aa, Artificial Sequence
  Description of Artificial Sequence: Synthetic peptide
  DOM23h-854 vhCDR3
QDLHGTSSLFDY

SEQ ID NO: 736 - protein, 120 aa, Artificial Sequence
  Description of Artificial Sequence: Synthetic polypeptide
  DOM23h-855 Variable heavy (vh) domain
EVQLLESGGGLVQPGGSLRLSCAASGFTFENTSMGWVRQAPGKGLEWVSRIDPKGSHTYYADSVKGRFTISRDNSKNTLYLQMNSLRAEDTAVYYCAKQRELGKSHFDYWGQGTLVTVSS

SEQ ID NO: 737 - protein, 5 aa, Artificial Sequence
  Description of Artificial Sequence: Synthetic peptide
  DOM23h-855 vhCDR1
NTSMG

SEQ ID NO: 738 - protein, 17 aa, Artificial Sequence
  Description of Artificial Sequence: Synthetic peptide
  DOM23h-855 vhCDR2
RIDPKGSHTYYADSVKG

SEQ ID NO: 739 - protein, 11 aa, Artificial Sequence
  Description of Artificial Sequence: Synthetic peptide
  DOM23h-855 vhCDR3
QRELGKSHFDY

SEQ ID NO: 740 - protein, 119 aa, Artificial Sequence
  Description of Artificial Sequence: Synthetic polypeptide
  DOM23h-865 Variable heavy (vh) domain
EVQLLESGGGLVQPGGSLRLSCAASGFTFRSYEMTWVRQAPGKGLEWVSKIDPSGRFTYYADSVKGRFTISRDNSKNTLYLQMNSLRAEDTAVYYCAKGRTDLQLFDYWGQGTLVTVSS

SEQ ID NO: 741 - protein, 5 aa, Artificial Sequence
  Description of Artificial Sequence: Synthetic peptide
  DOM23h-865 vhCDR1
SYEMT

SEQ ID NO: 742 - protein, 17 aa, Artificial Sequence
  Description of Artificial Sequence: Synthetic peptide
  DOM23h-865 vhCDR2
KIDPSGRFTYYADSVKG

SEQ ID NO: 743 - protein, 10 aa, Artificial Sequence
  Description of Artificial Sequence: Synthetic peptide
  DOM23h-865 vhCDR3
GRTDLQLFDY

SEQ ID NO: 744 - protein, 121 aa, Artificial Sequence
  Description of Artificial Sequence: Synthetic polypeptide
  DOM23h-866 Variable heavy (vh) domain
EVQLLESGGGLVQPGGSLRLSCAASGFTFSNYWMRWARQAPGKGLEWVSYITPKGDHTYYADSVKGRFTISRDNSKNTLYLQMNSLRAEDTAVYYCAESLHNERVKHFDYWGQGTLVTVSS

SEQ ID NO: 745 - protein, 5 aa, Artificial Sequence
  Description of Artificial Sequence: Synthetic peptide
  DOM23h-866 vhCDR1
NYWMR

SEQ ID NO: 746 - protein, 17 aa, Artificial Sequence
  Description of Artificial Sequence: Synthetic peptide
  DOM23h-866 vhCDR2
YITPKGDHTYYADSVKG

SEQ ID NO: 747 - protein, 12 aa, Artificial Sequence
  Description of Artificial Sequence: Synthetic peptide
  DOM23h-866 vhCDR3
SLHNERVKHFDY

SEQ ID NO: 748 - protein, 121 aa, Artificial Sequence
  Description of Artificial Sequence: Synthetic polypeptide
  DOM23h-874 Variable heavy (vh) domain
EVQLLESGGGLVQPGGSLRLSCAASGFTFTSYRMWWVRQAPGKGLEWVSVIDSTGSATYYADSVKGRFTISRDNSKNTLYLQMNSLRAEDTAVYYCAKQQAGSAMGEFDYWGQGTLVTVSS

SEQ ID NO: 749 - protein, 5 aa, Artificial Sequence
  Description of Artificial Sequence: Synthetic peptide
  DOM23h-874 vhCDR1
SYRMW

SEQ ID NO: 750 - protein, 17 aa, Artificial Sequence
  Description of Artificial Sequence: Synthetic peptide
  DOM23h-874 vhCDR2
VIDSTGSATYYADSVKG

SEQ ID NO: 751 - protein, 12 aa, Artificial Sequence
  Description of Artificial Sequence: Synthetic peptide
  DOM23h-874 vhCDR3
QQAGSAMGEFDY

SEQ ID NO: 752 - protein, 116 aa, Artificial Sequence
  Description of Artificial Sequence: Synthetic polypeptide
  DOM23h-883 Variable heavy (vh) domain
EVQLLESGGGLVQPGGSLRLSCAASGFTFVNYRMWWVRQAPGKGLEWVSAISGSGDKTYYADSVKGRFTISRDNSKNTLYLQMNSLRAEDTAVYYCAKHGLSFDYWGQGTLVTVSS

SEQ ID NO: 753 - protein, 5 aa, Artificial Sequence
  Description of Artificial Sequence: Synthetic peptide
  DOM23h-883 vhCDR1
NYRMW

SEQ ID NO: 754 - protein, 17 aa, Artificial Sequence
  Description of Artificial Sequence: Synthetic peptide
  DOM23h-883 vhCDR2
AISGSGDKTYYADSVKG

SEQ ID NO: 755 - protein, 7 aa, Artificial Sequence
  Description of Artificial Sequence: Synthetic peptide
  DOM23h-883 vhCDR3
HGLSFDY

SEQ ID NO: 756 - protein, 116 aa, Artificial Sequence
  Description of Artificial Sequence: Synthetic polypeptide
  DOM23h-903 Variable heavy (vh) domain
EVQLLESGGGLVQPGGSLRLSCAASGFTFNDMRMWWVRQAPGKGLEWVSVINADGNRTYYADSVKGRFTISRDNSKNTLYLQMNSLRAEDTAVYYCAKDGLPFDYWGQGTLVTVSS

SEQ ID NO: 757 - protein, 5 aa, Artificial Sequence
  Description of Artificial Sequence: Synthetic peptide
  DOM23h-903 vhCDR1
DMRMW

SEQ ID NO: 758 - protein, 17 aa, Artificial Sequence
  Description of Artificial Sequence: Synthetic peptide
  DOM23h-903 vhCDR2
VINADGNRTYYADSVKG

SEQ ID NO: 759 - protein, 7 aa, Artificial Sequence
  Description of Artificial Sequence: Synthetic peptide
  DOM23h-903 vhCDR3
DGLPFDY

SEQ ID NO: 760 - protein, 123 aa, Artificial Sequence
  Description of Artificial Sequence: Synthetic polypeptide
  DOM23m-4 Variable heavy (vh) domain
EVQLLESGGGLVQPGGSLRLSCAASGFTFTTYGMGWVRQAPGKGLEWVSWIEKTGNKTYYADSVKGRFTISRDNSKNTLYLQMNSLRAEDTAVYYCAKAGRHIKVRSRDFDYWGQGTLVTVSS

SEQ ID NO: 761 - protein, 5 aa, Artificial Sequence
  Description of Artificial Sequence: Synthetic peptide
  DOM23m-4 vhCDR1
TYGMG

SEQ ID NO: 762 - protein, 17 aa, Artificial Sequence
  Description of Artificial Sequence: Synthetic peptide
  DOM23m-4 vhCDR2
WIEKTGNKTYYADSVKG

SEQ ID NO: 763 - protein, 14 aa, Artificial Sequence
  Description of Artificial Sequence: Synthetic peptide
  DOM23m-4 vhCDR3
AGRHIKVRSRDFDY

SEQ ID NO: 764 - protein, 123 aa, Artificial Sequence
  Description of Artificial Sequence: Synthetic polypeptide
  DOM23m-29 Variable heavy (vh) domain
EVQLLESGGGLVQPGGSLRLSCAASGFTFKRYSMGWVRQAPGKGLEWVSVINDLGSLTYYADSVKGRFTISRDNSKNTLYLQMNSLRAEDTAVYYCAKGNISMVRPGSWFDYWGQGTLVTVSS

SEQ ID NO: 765 - protein, 5 aa, Artificial Sequence
  Description of Artificial Sequence: Synthetic peptide
  DOM23m-29 vhCDR1
RYSMG

SEQ ID NO: 766 - protein, 17 aa, Artificial Sequence
  Description of Artificial Sequence: Synthetic peptide
  DOM23m-29 vhCDR2
VINDLGSLTYYADSVKG

SEQ ID NO: 767 - protein, 14 aa, Artificial Sequence
  Description of Artificial Sequence: Synthetic peptide
  DOM23m-29 vhCDR3
GNISMVRPGSWFDY

SEQ ID NO: 768 - protein, 123 aa, Artificial Sequence
  Description of Artificial Sequence: Synthetic polypeptide
  DOM23m-32 Variable heavy (vh) domain
EVQLLESGGGLVQPGGSLRLSCAASGFTFFEYPMGWVRQAPGKGLEWVSVISGDGQRTYYADSVKGRFTISRDNSKNTLYLQMNSLRAEDTAVYYCAKSHTGTVRHLETFDYWGQGTLVTVSS

SEQ ID NO: 769 - protein, 5 aa, Artificial Sequence
  Description of Artificial Sequence: Synthetic peptide
  DOM23m-32 vhCDR1
EYPMG

SEQ ID NO: 770 - protein, 17 aa, Artificial Sequence
  Description of Artificial Sequence: Synthetic peptide
  DOM23m-32 vhCDR2
VISGDGQRTYYADSVKG

SEQ ID NO: 771 - protein, 14 aa, Artificial Sequence
  Description of Artificial Sequence: Synthetic peptide
  DOM23m-32 vhCDR3
SHTGTVRHLETFDY

SEQ ID NO: 772 - protein, 120 aa, Artificial Sequence
  Description of Artificial Sequence: Synthetic polypeptide
  DOM23m-62 Variable heavy (vh) domain
EVQLLESGGGLVQPGGSLRLSCAASGFTFGQESMYWVRQAPGKGLEWVSAISGSGGSTYYADSVKGRFTISRDNSKNTLYLQMNSLRAEDTAVYYCAKSGTRIKQGFDYWGQGTLVTVSS

SEQ ID NO: 773 - protein, 5 aa, Artificial Sequence
  Description of Artificial Sequence: Synthetic peptide
  DOM23m-62 vhCDR1
QESMY

SEQ ID NO: 774 - protein, 17 aa, Artificial Sequence
  Description of Artificial Sequence: Synthetic peptide
  DOM23m-62 vhCDR2
AISGSGGSTYYADSVKG

SEQ ID NO: 775 - protein, 11 aa, Artificial Sequence
  Description of Artificial Sequence: Synthetic peptide
  DOM23m-62 vhCDR3
SGTRIKQGFDY

SEQ ID NO: 776 - protein, 123 aa, Artificial Sequence
  Description of Artificial Sequence: Synthetic polypeptide
  DOM23m-71 Variable heavy (vh) domain
EVQLLESGGGLVQPGGSLRLSCAASGFTFMDYRMYWVRQAPGKGLEWVSGIDPTGLRTYYADSVKGRFTISRDNSKNTLYLQMNSLRAEDTAVYYCAKIKWGEMGSYKTFDYWGQGTLVTVSS

SEQ ID NO: 777 - protein, 5 aa, Artificial Sequence
  Description of Artificial Sequence: Synthetic peptide
  DOM23m-71 vhCDR1
DYRMY

SEQ ID NO: 778 - protein, 17 aa, Artificial Sequence
  Description of Artificial Sequence: Synthetic peptide
  DOM23m-71 vhCDR2
GIDPTGLRTYYADSVKG

SEQ ID NO: 779 - protein, 14 aa, Artificial Sequence
  Description of Artificial Sequence: Synthetic peptide
  DOM23m-71 vhCDR3
IKWGEMGSYKTFDY

SEQ ID NO: 780 - protein, 124 aa, Artificial Sequence
  Description of Artificial Sequence: Synthetic polypeptide
  DOM23m-72 Variable heavy (vh) domain
EVQLLESGGGLVQPGGSLRLSCAASGFTFMDYDMSWVRQAPGKGLEWVSMIREDGGKTYYADSVKGRFTISRDNSKNTLYLQMNSLRAEDTAVYYCAKARVPYRRGHRDNFDYWGQGTLVTVSS

SEQ ID NO: 781 - protein, 5 aa, Artificial Sequence
  Description of Artificial Sequence: Synthetic peptide
  DOM23m-72 vhCDR1
DYDMS

SEQ ID NO: 782 - protein, 17 aa, Artificial Sequence
  Description of Artificial Sequence: Synthetic peptide
  DOM23m-72 vhCDR2
MIREDGGKTYYADSVKG

SEQ ID NO: 783 - protein, 15 aa, Artificial Sequence
  Description of Artificial Sequence: Synthetic peptide
  DOM23m-72 vhCDR3
ARVPYRRGHRDNFDY

SEQ ID NO: 784 - protein, 120 aa, Artificial Sequence
  Description of Artificial Sequence: Synthetic polypeptide
  DOM23m-81 Variable heavy (vh) domain
EVQLLESGGGLVQPGGSLRLSCAASGFTFEPVIMGWVRQAPGKGLEWVSAIEARGGGTYYADSVKGRFTISRDNSKNTLYLQMNSLRAEDTAVYYCAKPGRHLSQDFDYWGQGTLVTVSS

SEQ ID NO: 785 - protein, 5 aa, Artificial Sequence
  Description of Artificial Sequence: Synthetic peptide
  DOM23m-81 vhCDR1
PVIMG

SEQ ID NO: 786 - protein, 17 aa, Artificial Sequence
  Description of Artificial Sequence: Synthetic peptide
  DOM23m-81 vhCDR2
AIEARGGGTYYADSVKG

SEQ ID NO: 787 - protein, 11 aa, Artificial Sequence
  Description of Artificial Sequence: Synthetic peptide
  DOM23m-81 vhCDR3
PGRHLSQDFDY

SEQ ID NO: 788 - protein, 119 aa, Artificial Sequence
  Description of Artificial Sequence: Synthetic polypeptide
  DOM23m-99 Variable heavy (vh) domain
EVQLLESGGGLVQPGGSLRLSCAASGFTFDRYRMMWVRQAPGKGLEWVSTIDPAGMLTYYADSVKGRFTISRDNSKNTLYLQMNSLRAEDTAVYYCAKRLASRSHFDYWGQGTLVTVSS

SEQ ID NO: 789 - protein, 5 aa, Artificial Sequence
  Description of Artificial Sequence: Synthetic peptide
  DOM23m-99 vhCDR1
RYRMM

SEQ ID NO: 790 - protein, 17 aa, Artificial Sequence
  Description of Artificial Sequence: Synthetic peptide
  DOM23m-99 vhCDR2
TIDPAGMLTYYADSVKG

SEQ ID NO: 791 - protein, 10 aa, Artificial Sequence
  Description of Artificial Sequence: Synthetic peptide
  DOM23m-99 vhCDR3
RLASRSHFDY

SEQ ID NO: 792 - protein, 119 aa, Artificial Sequence
  Description of Artificial Sequence: Synthetic polypeptide
  DOM23m-101 Variable heavy (vh) domain
EVQLLESGGGLVQPGGSLRLSCAASGFTFSEYDMAWVRQAPGKGLEWVSRIRSDGVRTYYADSVKGRFTISRDNSKNTLYLQMNSLRAEDTAVYYCAKDRAKNGWFDYWGQGTLVTVSS

SEQ ID NO: 793 - protein, 5 aa, Artificial Sequence
  Description of Artificial Sequence: Synthetic peptide
  DOM23m-101 vhCDR1
EYDMA

SEQ ID NO: 794 - protein, 17 aa, Artificial Sequence
  Description of Artificial Sequence: Synthetic peptide
  DOM23m-101 vhCDR2
RIRSDGVRTYYADSVKG

SEQ ID NO: 795 - protein, 10 aa, Artificial Sequence
  Description of Artificial Sequence: Synthetic peptide
  DOM23m-101 vhCDR3
DRAKNGWFDY

SEQ ID NO: 796 - protein, 119 aa, Artificial Sequence
  Description of Artificial Sequence: Synthetic polypeptide
  DOM23m-352 Variable heavy (vh) domain
EVQLLESGGGLVQPGGSLRLSCAASGFTFDKYKMAWVRQAPGKGLEWVSLIFPNGVPTYYANSVKGRFTISRDNSKNTLYLQMNSLRAEDTAVYYCAKYSGQGRDFDYWGQGTLVTVSS

SEQ ID NO: 797 - protein, 5 aa, Artificial Sequence
  Description of Artificial Sequence: Synthetic peptide
  DOM23m-352 vhCDR1
KYKMA

SEQ ID NO: 798 - protein, 17 aa, Artificial Sequence
  Description of Artificial Sequence: Synthetic peptide
  DOM23m-352 vhCDR2
LIFPNGVPTYYANSVKG

SEQ ID NO: 799 - protein, 10 aa, Artificial Sequence
  Description of Artificial Sequence: Synthetic peptide
  DOM23m-352 vhCDR3
YSGQGRDFDY

SEQ ID NO: 800 - protein, 124 aa, Artificial Sequence
  Description of Artificial Sequence: Synthetic polypeptide
  DOM23h-271-21 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQMPGRKWTAKFRWDYWGQGTLVIVSS

SEQ ID NO: 801 - protein, 5 aa, Artificial Sequence
  Description of Artificial Sequence: Synthetic peptide
  DOM23h-271-21 vhCDR1
EYRMW

SEQ ID NO: 802 - protein, 17 aa, Artificial Sequence
  Description of Artificial Sequence: Synthetic peptide
  DOM23h-271-21 vhCDR2
AIEPIGNRTYYADSVKG

SEQ ID NO: 803 - protein, 15 aa, Artificial Sequence
  Description of Artificial Sequence: Synthetic peptide
  DOM23h-271-21 vhCDR3
QMPGRKWTAKFRWDY

SEQ ID NO: 804 - protein, 124 aa, Artificial Sequence
  Description of Artificial Sequence: Synthetic polypeptide
  DOM23h-271-22 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQMPGQKWMAKSRFDYWGQGTLVTVSS

SEQ ID NO: 805 - protein, 5 aa, Artificial Sequence
  Description of Artificial Sequence: Synthetic peptide
  DOM23h-271-22 vhCDR1
EYRMW

SEQ ID NO: 806 - protein, 17 aa, Artificial Sequence
  Description of Artificial Sequence: Synthetic peptide
  DOM23h-271-22 vhCDR2
AIEPIGNRTYYADSVKG

SEQ ID NO: 807 - protein, 15 aa, Artificial Sequence
  Description of Artificial Sequence: Synthetic peptide
  DOM23h-271-22 vhCDR3
QMPGQKWMAKSRFDY

SEQ ID NO: 808 - protein, 124 aa, Artificial Sequence
  Description of Artificial Sequence: Synthetic polypeptide
  DOM23h-271-27 Variable heavy (vh) domain
EVQLLESGGGLVQPGGSLRLSCAASGFTFTEYRMWWVRQAPGKGLEWVSAIEPIGQKTYYADSVKGRFTISRDNSKNTLYLQMNSLRAEDTAVYYCAKQIPGRKWTANSRFDYWGQGTLVIVSS

SEQ ID NO: 809 - protein, 5 aa, Artificial Sequence
  Description of Artificial Sequence: Synthetic peptide
  DOM23h-271-27 vhCDR1
EYRMW

SEQ ID NO: 810 - protein, 17 aa, Artificial Sequence
  Description of Artificial Sequence: Synthetic peptide
  DOM23h-271-27 vhCDR2
AIEPIGQKTYYADSVKG

SEQ ID NO: 811 - protein, 15 aa, Artificial Sequence
  Description of Artificial Sequence: Synthetic peptide
  DOM23h-271-27 vhCDR3
QIPGRKWTANSRFDY

SEQ ID NO: 812 - protein, 124 aa, Artificial Sequence
  Description of Artificial Sequence: Synthetic polypeptide
  DOM23h-271-101 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQIPGRKWTANGRKDYWGQGTLVTVSS

SEQ ID NO: 813 - protein, 5 aa, Artificial Sequence
  Description of Artificial Sequence: Synthetic peptide
  DOM23h-271-101 vhCDR1
EYRMW

SEQ ID NO: 814 - protein, 17 aa, Artificial Sequence
  Description of Artificial Sequence: Synthetic peptide
  DOM23h-271-101 vhCDR2
AIEPIGNRTYYADSVKG

SEQ ID NO: 815 - protein, 15 aa, Artificial Sequence
  Description of Artificial Sequence: Synthetic peptide
  DOM23h-271-101 vhCDR3
QIPGRKWTANGRKDY

SEQ ID NO: 816 - protein, 124 aa, Artificial Sequence
  Description of Artificial Sequence: Synthetic polypeptide
  DOM23h-271-102 Variable heavy (vh) domain
EVQLLESGGGLVQPGGSLRLSCAASGSTFTEYRMWWVRQAPGKGLEWVSAIEPIGHRTYYADSVKGRFTISRDNSKNTLYLQMNSLRAEDTAVYYCAKQIPGRKWTANSRFDYWGQGTLVTVSS

SEQ ID NO: 817 - protein, 5 aa, Artificial Sequence
  Description of Artificial Sequence: Synthetic peptide
  DOM23h-271-102 vhCDR1
EYRMW

SEQ ID NO: 818 - protein, 17 aa, Artificial Sequence
  Description of Artificial Sequence: Synthetic peptide
  DOM23h-271-102 vhCDR2
AIEPIGHRTYYADSVKG

SEQ ID NO: 819 - protein, 15 aa, Artificial Sequence
  Description of Artificial Sequence: Synthetic peptide
  DOM23h-271-102 vhCDR3
QIPGRKWTANSRFDY

SEQ ID NO: 820 - protein, 124 aa, Artificial Sequence
  Description of Artificial Sequence: Synthetic polypeptide
  DOM23h-271-105 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQIPGQRWTGNSRFDYWGQGTLVTVSS

SEQ ID NO: 821 - protein, 5 aa, Artificial Sequence
  Description of Artificial Sequence: Synthetic peptide
  DOM23h-271-105 vhCDR1
EYRMW

SEQ ID NO: 822 - protein, 17 aa, Artificial Sequence
  Description of Artificial Sequence: Synthetic peptide
  DOM23h-271-105 vhCDR2
AIEPIGNRTYYADSVKG

SEQ ID NO: 823 - protein, 15 aa, Artificial Sequence
  Description of Artificial Sequence: Synthetic peptide
  DOM23h-271-105 vhCDR3
QIPGQRWTGNSRFDY

SEQ ID NO: 824 - protein, 124 aa, Artificial Sequence
  Description of Artificial Sequence: Synthetic polypeptide
  DOM23h-271-106 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQFPGRKWTANSRSDYWGQGTLVTVSS

SEQ ID NO: 825 - protein, 5 aa, Artificial Sequence
  Description of Artificial Sequence: Synthetic peptide
  DOM23h-271-106 vhCDR1
EYRMW

SEQ ID NO: 826 - protein, 17 aa, Artificial Sequence
  Description of Artificial Sequence: Synthetic peptide
  DOM23h-271-106 vhCDR2
AIEPIGNRTYYADSVKG

SEQ ID NO: 827 - protein, 15 aa, Artificial Sequence
  Description of Artificial Sequence: Synthetic peptide
  DOM23h-271-106 vhCDR3
QFPGRKWTANSRSDY

SEQ ID NO: 828 - protein, 124 aa, Artificial Sequence
  Description of Artificial Sequence: Synthetic polypeptide
  DOM23h-271-114 Variable heavy (vh) domain
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQIPGRKGTANSRFDYWGQGTLVTVSS

SEQ ID NO: 829 - protein, 5 aa, Artificial Sequence
  Description of Artificial Sequence: Synthetic peptide
  DOM23h-271-114 vhCDR1
EYRMW

SEQ ID NO: 830 - protein, 17 aa, Artificial Sequence
  Description of Artificial Sequence: Synthetic peptide
  DOM23h-271-114 vhCDR2
AIEPIGNRTYYADSVKG

SEQ ID NO: 831 - protein, 15 aa, Artificial Sequence
  Description of Artificial Sequence: Synthetic peptide
  DOM23h-271-114 vhCDR3
QIPGRKGTANSRFDY

SEQ ID NO: 832 - protein, 124 aa, Artificial Sequence
  Description of Artificial Sequence: Synthetic polypeptide
  DOM23h-271-39 Variable heavy (vh) domain
EVQLLESGGGLVQPGGSLRLSCAASGFTFTEYRMWWVRQAPGKGLEWVSAIEPIGNRTYYARSVDGRFTISRDNSKNTLYLQMNSLRAEDTAVYYCAKQMPGQKWMAKSRFDYWGQGTLVTVSS

SEQ ID NO: 833 - protein, 5 aa, Artificial Sequence
  Description of Artificial Sequence: Synthetic peptide
  DOM23h-271-39 vhCDR1
EYRMW

SEQ ID NO: 834 - protein, 17 aa, Artificial Sequence
  Description of Artificial Sequence: Synthetic peptide
  DOM23h-271-39 vhCDR2
AIEPIGNRTYYARSVDG

SEQ ID NO: 835 - protein, 15 aa, Artificial Sequence
  Description of Artificial Sequence: Synthetic peptide
  DOM23h-271-39 vhCDR3
QMPGQKWMAKSRFDY

SEQ ID NO: 836 - protein, 124 aa, Artificial Sequence
  Description of Artificial Sequence: Synthetic polypeptide
  DOM23h-271-40 Variable heavy (vh) domain
EVQLLESGGGLVQPGGSLRLSCAASGFTFTEYRMWWVRQAPGKGLEWVSAIEPIGNRTYYARSVFGRFTISRDNSKNTLYLQMNSLRAEDTAVYYCAKQMPGQKWMAKSRFDYWGQGTLVTVSS

SEQ ID NO: 837 - protein, 5 aa, Artificial Sequence
  Description of Artificial Sequence: Synthetic peptide
  DOM23h-271-40 vhCDR1
EYRMW

SEQ ID NO: 838 - protein, 17 aa, Artificial Sequence
  Description of Artificial Sequence: Synthetic peptide
  DOM23h-271-40 vhCDR2
AIEPIGNRTYYARSVFG

SEQ ID NO: 839 - protein, 15 aa, Artificial Sequence
  Description of Artificial Sequence: Synthetic peptide
  DOM23h-271-40 vhCDR3
QMPGQKWMAKSRFDY

SEQ ID NO: 840 - protein, 124 aa, Artificial Sequence; identical to SEQ ID NO: 652
  Description of Artificial Sequence: Synthetic polypeptide
  DOM23h-271 Variable heavy (vh) domain

SEQ ID NO: 841 - protein, 5 aa, Artificial Sequence
  Description of Artificial Sequence: Synthetic peptide
  DOM23h-271 vhCDR1
EYRMW

SEQ ID NO: 842 - protein, 17 aa, Artificial Sequence
  Description of Artificial Sequence: Synthetic peptide
  DOM23h-271 vhCDR2
AIEPIGNRTYYADSVKG

SEQ ID NO: 843 - protein, 15 aa, Artificial Sequence
  Description of Artificial Sequence: Synthetic peptide
  DOM23h-271 vhCDR3
QIPGRKWTANSRFDY

SEQ ID NO: 844 - protein, 124 aa, Artificial Sequence; identical to SEQ ID NO: 652
  Description of Artificial Sequence: Synthetic polypeptide
  DOM23h-271-7 Variable heavy (vh) domain

SEQ ID NO: 845 - protein, 5 aa, Artificial Sequence
  Description of Artificial Sequence: Synthetic peptide
  DOM23h-271-7 vhCDR1
EYRMW

SEQ ID NO: 846 - protein, 17 aa, Artificial Sequence
  Description of Artificial Sequence: Synthetic peptide
  DOM23h-271-7 vhCDR2
AIEPIGNRTYYADSVKG

SEQ ID NO: 847 - protein, 15 aa, Artificial Sequence
  Description of Artificial Sequence: Synthetic peptide
  DOM23h-271-7 vhCDR3
QIPGRKWTANSRFDY

SEQ ID NO: 848 - protein, 120 aa, Artificial Sequence
  Description of Artificial Sequence: Synthetic polypeptide
  DOM23h-855-21 Variable heavy (vh) domain
EVQLLESGGGLVQPGGSLRLSCAASGFTFENTSMGWVRQAPGKGLEWVSRIDPKGSHTYYTDSVKGRFTISRDNSKNTLYLQMNSLRAEDTAVYYCAKQRELGKSYFDYWGQGTLVTVSS

SEQ ID NO: 849 - protein, 5 aa, Artificial Sequence
  Description of Artificial Sequence: Synthetic peptide
  DOM23h-855-21 vhCDR1
NTSMG

SEQ ID NO: 850 - protein, 17 aa, Artificial Sequence
  Description of Artificial Sequence: Synthetic peptide
  DOM23h-855-21 vhCDR2
RIDPKGSHTYYTDSVKG

SEQ ID NO: 851 - protein, 11 aa, Artificial Sequence
  Description of Artificial Sequence: Synthetic peptide
  DOM23h-855-21 vhCDR3
QRELGKSYFDY

SEQ ID NO: 852 - protein, 120 aa, Artificial Sequence
  Description of Artificial Sequence: Synthetic polypeptide
  DOM23h-843-13 Variable heavy (vh) domain
EVQLLESGGGLVQPGGSLRLSCAASGFTFDQDRMWWVRQAPGKGLEWVSAIESGGHRTYYADSVKGRFTISRDNSKNTLYLQMNSLRAEDTAVYYCANQNKSGRSGFDYWGQGTLVTVSS

SEQ ID NO: 853 - protein, 5 aa, Artificial Sequence
  Description of Artificial Sequence: Synthetic peptide
  DOM23h-843-13 vhCDR1
QDRMW

SEQ ID NO: 854 - protein, 17 aa, Artificial Sequence
  Description of Artificial Sequence: Synthetic peptide
  DOM23h-843-13 vhCDR2
AIESGGHRTYYADSVKG

SEQ ID NO: 855 - protein, 11 aa, Artificial Sequence
  Description of Artificial Sequence: Synthetic peptide
  DOM23h-843-13 vhCDR3
QNKSGRSGFDY

SEQ ID NO: 856 - protein, 122 aa, Artificial Sequence
  Description of Artificial Sequence: Synthetic polypeptide
  DOM23h-439-20 Variable heavy (vh) domain
EVQLLESGGGLVQPGGSLRLSCAASGFTFGTEQMWWVRQAPGKGLEFVSRIDSPGGRTYYADSVKGRFTISRDNSKNTLYLQMNSLRAEDTAVYYCAKRHAAGVSGTYFDYWGQGTLVTVSS

SEQ ID NO: 857 - protein, 5 aa, Artificial Sequence
  Description of Artificial Sequence: Synthetic peptide
  DOM23h-439-20 vhCDR1
TEQMW

SEQ ID NO: 858 - protein, 17 aa, Artificial Sequence
  Description of Artificial Sequence: Synthetic peptide
  DOM23h-439-20 vhCDR2
RIDSPGGRTYYADSVKG

SEQ ID NO: 859 - protein, 13 aa, Artificial Sequence
  Description of Artificial Sequence: Synthetic peptide
  DOM23h-439-20 vhCDR3
RHAAGVSGTYFDY

SEQ ID NO: 860 - protein, 124 aa, Artificial Sequence
  Description of Artificial Sequence: Synthetic polypeptide
  DOM-271-50 Variable heavy (vh) domain
EVQLLESGGGLVQPGGSLRLSCAASGSTFTEYRMWWVRQAPGKGLEWVSAIEPIGHRTYYADSVKGRFTISRDNSKNTLYLQMNSLRAEDTAVYYCAKQAPGEKWLARGRLDYWGQGTLVTVSS

SEQ ID NO: 861 - protein, 5 aa, Artificial Sequence
  Description of Artificial Sequence: Synthetic peptide
  DOM-271-50 vhCDR1
EYRMW

SEQ ID NO: 862 - protein, 17 aa, Artificial Sequence
  Description of Artificial Sequence: Synthetic peptide
  DOM-271-50 vhCDR2
AIEPIGHRTYYADSVKG

SEQ ID NO: 863 - protein, 15 aa, Artificial Sequence
  Description of Artificial Sequence: Synthetic peptide
  DOM-271-50 vhCDR3
QAPGEKWLARGRLDY

SEQ ID NO: 864 - protein, 122 aa, Artificial Sequence
  Description of Artificial Sequence: Synthetic polypeptide
  DOM23h-439-25 Variable heavy (vh) domain
EVQLLESGGGLVQPGGSLRLSCAASGFTFGTEQMWWVRQAPGKGLEFVSRIDSPGGRTYYADSVKGRFTISRDNSKNTLYLQMNSLRAEDTAVYYCAKRRPTGVSGTFYDYWGQGTLVTVSS

SEQ ID NO: 865 - protein, 5 aa, Artificial Sequence
  Description of Artificial Sequence: Synthetic peptide
  DOM23h-439-25 vhCDR1
TEQMW

SEQ ID NO: 866 - protein, 17 aa, Artificial Sequence
  Description of Artificial Sequence: Synthetic peptide
  DOM23h-439-25 vhCDR2
RIDSPGGRTYYADSVKG

SEQ ID NO: 867 - protein, 13 aa, Artificial Sequence
  Description of Artificial Sequence: Synthetic peptide
  DOM23h-439-25 vhCDR3
RRPTGVSGTFYDY

SEQ ID NO: 868 - protein, 124 aa, Artificial Sequence
  Description of Artificial Sequence: Synthetic polypeptide
  DOM23h-271-123 Variable heavy (vh) domain
EVQLLESGGGLVQPGGSLRLSCAASGSTFTEYRMWWVRQAPGKGLEWVSAIEPIGHRTYYADSVKGRFTISRDNSKNTLYLQMNSLRAEDTAVYYCAKQAPGEKWARRWDLDYWGQGTLVTVSS

SEQ ID NO: 869 - protein, 5 aa, Artificial Sequence
  Description of Artificial Sequence: Synthetic peptide
  DOM23h-271-123 vhCDR1
EYRMW

SEQ ID NO: 870 - protein, 17 aa, Artificial Sequence
  Description of Artificial Sequence: Synthetic peptide
  DOM23h-271-123 vhCDR2
AIEPIGHRTYYADSVKG

SEQ ID NO: 871 - protein, 14 aa, Artificial Sequence
  Description of Artificial Sequence: Synthetic peptide
  DOM23h-271-123 vhCDR3
QAPGEKWARRWDLD

SEQ ID NO: 872 - protein, 122 aa, Artificial Sequence
  Description of Artificial Sequence: Synthetic polypeptide
  DOM23h-439-35 Variable heavy (vh) domain
EVQLLESGGGLVQPGGSLRLSCAASGFTFGTDQMWWVRQAPGKGLEFVSRIDSPGGRTYYANSVKGRFTISRDNSKNTLYLQMNSLRAEDTAVYYCAKRQPAGVSGKYVDYWGQGTLVTVSS

SEQ ID NO: 873 - protein, 5 aa, Artificial Sequence
  Description of Artificial Sequence: Synthetic peptide
  DOM23h-439-35 vhCDR1
TDQMW

SEQ ID NO: 874 - protein, 17 aa, Artificial Sequence
  Description of Artificial Sequence: Synthetic peptide
  DOM23h-439-35 vhCDR2
RIDSPGGRTYYANSVKG

SEQ ID NO: 875 - protein, 13 aa, Artificial Sequence
  Description of Artificial Sequence: Synthetic peptide
  DOM23h-439-35 vhCDR3
RQPAGVSGKYVDY

SEQ ID NO: 876 - protein, 124 aa, Artificial Sequence
  Description of Artificial Sequence: Synthetic polypeptide
  DOM23h-271-129 Variable heavy (vh) domain
EVQLLESGGGLVQPGGSLRLSCAASGSTFTEYRMWWVRQAPGKGLEWVSAIEPIGHRTYYADSVKGRFTISRDNSKNTLYLQMNSLRAEDTAVYYCAKQAPNQRYVARGRLDYWGQGTLVTVSS

SEQ ID NO: 877 - protein, 5 aa, Artificial Sequence
  Description of Artificial Sequence: Synthetic peptide
  DOM23h-271-129 vhCDR1
EYRMW

SEQ ID NO: 878 - protein, 17 aa, Artificial Sequence
  Description of Artificial Sequence: Synthetic peptide
  DOM23h-271-129 vhCDR2
AIEPIGHRTYYADSVKG

SEQ ID NO: 879 - protein, 15 aa, Artificial Sequence
  Description of Artificial Sequence: Synthetic peptide
  DOM23h-271-129 vhCDR3
QAPNQRYVARGRLDY

SEQ ID NO: 880 - protein, 122 aa, Artificial Sequence; identical to SEQ ID NO: 864
  Description of Artificial Sequence: Synthetic polypeptide
  DOM23h-439-40 Variable heavy (vh) domain

SEQ ID NO: 881 - protein, 5 aa, Artificial Sequence
  Description of Artificial Sequence: Synthetic peptide
  DOM23h-439-40 vhCDR1
TEQMW

SEQ ID NO: 882 - protein, 17 aa, Artificial Sequence
  Description of Artificial Sequence: Synthetic peptide
  DOM23h-439-40 vhCDR2
RIDSPGGRTYYADSVKG

SEQ ID NO: 883 - protein, 13 aa, Artificial Sequence
  Description of Artificial Sequence: Synthetic peptide
  DOM23h-439-40 vhCDR3
RRPTGVSGTFYDY

SEQ ID NO: 884 - protein, 122 aa, Artificial Sequence
  Description of Artificial Sequence: Synthetic polypeptide
  DOM23h-439-41 Variable heavy (vh) domain
EVQLLESGGGLVQPGGSLRLSCAASGFTFGTEQMWWVRQAPGKGLEFISRIDSPGGRTYYADSVKGRFTISRDNSKNTLYLQMNSLRAEDTAVYYCAKRRPTGVSGTFYDYWGQGTLVTVSS

SEQ ID NO: 885 - protein, 5 aa, Artificial Sequence
  Description of Artificial Sequence: Synthetic peptide
  DOM23h-439-41 vhCDR1
TEQMW

SEQ ID NO: 886 - protein, 17 aa, Artificial Sequence
  Description of Artificial Sequence: Synthetic peptide
  DOM23h-439-41 vhCDR2
RIDSPGGRTYYADSVKG

SEQ ID NO: 887 - protein, 13 aa, Artificial Sequence
  Description of Artificial Sequence: Synthetic peptide
  DOM23h-439-41 vhCDR3
RRPTGVSGTFYDY

SEQ ID NO: 888 - protein, 122 aa, Artificial Sequence
  Description of Artificial Sequence: Synthetic polypeptide
  DOM23h-439-42 Variable heavy (vh) domain
EVQLLESGGGLVQPGGSLRLSCAASGFTFGTEQMWWVRQAPGKGLEFVSRIDSPGGRTYYANSVKGRFTISRDNSKNTLYLQMNSLRAEDTAVYYCAKRRPTGVSGTFYDYWGQGTLVTVSS

SEQ ID NO: 889 - protein, 5 aa, Artificial Sequence
  Description of Artificial Sequence: Synthetic peptide
  DOM23h-439-42 vhCDR1
TEQMW

SEQ ID NO: 890 - protein, 17 aa, Artificial Sequence
  Description of Artificial Sequence: Synthetic peptide
  DOM23h-439-42 vhCDR2
RIDSPGGRTYYANSVKG

SEQ ID NO: 891 - protein, 13 aa, Artificial Sequence
  Description of Artificial Sequence: Synthetic peptide
  DOM23h-439-42 vhCDR3
RRPTGVSGTFYDY

SEQ ID NO: 892 - protein, 122 aa, Artificial Sequence
  Description of Artificial Sequence: Synthetic polypeptide
  DOM23h-439-43 Variable heavy (vh) domain
EVQLLESGGGLVQPGGSLRLSCAASGFTFGTEQMWWVRQAPGKGLEFVSRIDSPGGRTYYADSVRGRFTISRDNSKNTLYLQMNSLRAEDTAVYYCAKRRPTGVSGTFYDYWGQGTLVTVSS

SEQ ID NO: 893 - protein, 5 aa, Artificial Sequence
  Description of Artificial Sequence: Synthetic peptide
  DOM23h-439-43 vhCDR1
TEQMW

SEQ ID NO: 894 - protein, 17 aa, Artificial Sequence
  Description of Artificial Sequence: Synthetic peptide
  DOM23h-439-43 vhCDR2
RIDSPGGRTYYADSVRG

SEQ ID NO: 895 - protein, 13 aa, Artificial Sequence
  Description of Artificial Sequence: Synthetic peptide
  DOM23h-439-43 vhCDR3
RRPTGVSGTFYDY

SEQ ID NO: 896 - protein, 122 aa, Artificial Sequence
  Description of Artificial Sequence: Synthetic polypeptide
  DOM23h-439-44 Variable heavy (vh) domain
EVQLLESGGGLVQPGGSLRLSCAASGFTFGTEQMWWVRQAPGKGLEFVSRIDSPGGRTYYANSVRGRFTISRDNSKNTLYLQMNSLRAEDTAVYYCAKRRPTGVSGTFYDYWGQGTLVTVSS

SEQ ID NO: 897 - protein, 5 aa, Artificial Sequence
  Description of Artificial Sequence: Synthetic peptide
  DOM23h-439-44 vhCDR1
TEQMW

SEQ ID NO: 898 - protein, 17 aa, Artificial Sequence
  Description of Artificial Sequence: Synthetic peptide
  DOM23h-439-44 vhCDR2
RIDSPGGRTYYANSVRG

SEQ ID NO: 899 - protein, 13 aa, Artificial Sequence
  Description of Artificial Sequence: Synthetic peptide
  DOM23h-439-44 vhCDR3
RRPTGVSGTFYDY

SEQ ID NO: 900 - protein, 124 aa, Artificial Sequence; identical to SEQ ID NO: 868
  Description of Artificial Sequence: Synthetic polypeptide
  DOM23h-271-130 Variable heavy (vh) domain

SEQ ID NO: 901 - protein, 5 aa, Artificial Sequence
  Description of Artificial Sequence: Synthetic peptide
  DOM23h-271-130 vhCDR1
EYRMW

SEQ ID NO: 902 - protein, 17 aa, Artificial Sequence
  Description of Artificial Sequence: Synthetic peptide
  DOM23h-271-130 vhCDR2
AIEPIGHRTYYADSVKG

SEQ ID NO: 903 - protein, 15 aa, Artificial Sequence
  Description of Artificial Sequence: Synthetic peptide
  DOM23h-271-130 vhCDR3
QAPGEKWARRWDLDY

SEQ ID NO: 904 - protein, 124 aa, Artificial Sequence
  Description of Artificial Sequence: Synthetic polypeptide
  DOM23h-271-131 Variable heavy (vh) domain
EVQLLESGGGLVQPGGSLRLSCAASGSTFTEYRMWWVRQAPGKGLEWVSAIEPIGHRTYYANSVKGRFTISRDNSKNTLYLQMNSLRAEDTAVYYCAKQAPGEKWARRWDLDYWGQGTLVTVSS

SEQ ID NO: 905 - protein, 5 aa, Artificial Sequence
  Description of Artificial Sequence: Synthetic peptide
  DOM23h-271-131 vhCDR1
EYRMW

SEQ ID NO: 906 - protein, 17 aa, Artificial Sequence
  Description of Artificial Sequence: Synthetic peptide
  DOM23h-271-131 vhCDR2
AIEPIGHRTYYANSVKG

SEQ ID NO: 907 - protein, 15 aa, Artificial Sequence
  Description of Artificial Sequence: Synthetic peptide
  DOM23h-271-131 vhCDR3
QAPGEKWARRWDLDY

SEQ ID NO: 908 - protein, 124 aa, Artificial Sequence
  Description of Artificial Sequence: Synthetic polypeptide
  DOM23h-271-132 Variable heavy (vh) domain
EVQLLESGGGLVQPGGSLRLSCAASGSTFTEYRMWWVRQAPGKGLEWVSAIEPIGHRTYYADSVRGRFTISRDNSKNTLYLQMNSLRAEDTAVYYCAKQAPGEKWARRWDLDYWGQGTLVTVSS

SEQ ID NO: 909 - protein, 5 aa, Artificial Sequence
  Description of Artificial Sequence: Synthetic peptide
  DOM23h-271-132 vhCDR1
EYRMW

SEQ ID NO: 910 - protein, 17 aa, Artificial Sequence
  Description of Artificial Sequence: Synthetic peptide
  DOM23h-271-132 vhCDR2
AIEPIGHRTYYADSVRG

SEQ ID NO: 911 - protein, 15 aa, Artificial Sequence
  Description of Artificial Sequence: Synthetic peptide
  DOM23h-271-132 vhCDR3
QAPGEKWARRWDLDY

SEQ ID NO: 912 - protein, 124 aa, Artificial Sequence
  Description of Artificial Sequence: Synthetic polypeptide
  DOM23h-271-133 Variable heavy (vh) domain
EVQLLESGGGLVQPGGSLRLSCAASGSTFTEYRMWWVRQAPGKGLEWVSAIEPIGHRTYYANSVRGRFTISRDNSKNTLYLQMNSLRAEDTAVYYCAKQAPGEKWARRWDLDYWGQGTLVTVSS

SEQ ID NO: 913 - protein, 5 aa, Artificial Sequence
  Description of Artificial Sequence: Synthetic peptide
  DOM23h-271-133 vhCDR1
EYRMW

SEQ ID NO: 914 - protein, 17 aa, Artificial Sequence
  Description of Artificial Sequence: Synthetic peptide
  DOM23h-271-133 vhCDR2
AIEPIGHRTYYANSVRG

SEQ ID NO: 915 - protein, 15 aa, Artificial Sequence
  Description of Artificial Sequence: Synthetic peptide
  DOM23h-271-133 vhCDR3
QAPGEKWARRWDLDY

SEQ ID NO: 916 - protein, 124 aa, Artificial Sequence
  Description of Artificial Sequence: Synthetic polypeptide
  DOM23h-271-134 Variable heavy (vh) domain
EVQLLESGGGLVQPGGSLRLSCAASGSTFTEYRMWWVRQAPGKGLEWISAIEPIGHRTYYADSVKGRFTISRDNSKNTLYLQMNSLRAEDTAVYYCAKQAPGEKWARRWDLDYWGQGTLVTVSS

SEQ ID NO: 917 - protein, 5 aa, Artificial Sequence
  Description of Artificial Sequence: Synthetic peptide
  DOM23h-271-134 vhCDR1
EYRMW

SEQ ID NO: 918 - protein, 17 aa, Artificial Sequence
  Description of Artificial Sequence: Synthetic peptide
  DOM23h-271-134 vhCDR2
AIEPIGHRTYYADSVKG

SEQ ID NO: 919 - protein, 15 aa, Artificial Sequence
  Description of Artificial Sequence: Synthetic peptide
  DOM23h-271-134 vhCDR3
QAPGEKWARRWDLDY

SEQ ID NO: 920 - protein, 124 aa, Artificial Sequence; identical to SEQ ID NO: 876
  Description of Artificial Sequence: Synthetic polypeptide
  DOM23h-271-135 Variable heavy (vh) domain

SEQ ID NO: 921 - protein, 5 aa, Artificial Sequence
  Description of Artificial Sequence: Synthetic peptide
  DOM23h-271-135 vhCDR1
EYRMW

SEQ ID NO: 922 - protein, 17 aa, Artificial Sequence
  Description of Artificial Sequence: Synthetic peptide
  DOM23h-271-135 vhCDR2
AIEPIGHRTYYADSVKG

SEQ ID NO: 923 - protein, 15 aa, Artificial Sequence
  Description of Artificial Sequence: Synthetic peptide
  DOM23h-271-135 vhCDR3
QAPNQRYVARGRLDY

SEQ ID NO: 924 - protein, 124 aa, Artificial Sequence
  Description of Artificial Sequence: Synthetic polypeptide
  DOM23h-271-136 Variable heavy (vh) domain
EVQLLESGGGLVQPGGSLRLSCAASGSTFTEYRMWWVRQAPGKGLEWVSAIEPIGHRTYYANSVKGRFTISRDNSKNTLYLQMNSLRAEDTAVYYCAKQAPNQRYVARGRLDYWGQGTLVTVSS

SEQ ID NO: 925 - protein, 5 aa, Artificial Sequence
  Description of Artificial Sequence: Synthetic peptide
  DOM23h-271-136 vhCDR1
EYRMW

SEQ ID NO: 926 - protein, 17 aa, Artificial Sequence
  Description of Artificial Sequence: Synthetic peptide
  DOM23h-271-136 vhCDR2
AIEPIGHRTYYANSVKG

SEQ ID NO: 927 - protein, 15 aa, Artificial Sequence
  Description of Artificial Sequence: Synthetic peptide
  DOM23h-271-136 vhCDR3
QAPNQRYVARGRLDY

SEQ ID NO: 928 - protein, 124 aa, Artificial Sequence
  Description of Artificial Sequence: Synthetic polypeptide
  DOM23h-271-137 Variable heavy (vh) domain
EVQLLESGGGLVQPGGSLRLSCAASGSTFTEYRMWWVRQAPGKGLEWVSAIEPIGHRTYYANSVRGRFTISRDNSKNTLYLQMNSLRAEDTAVYYCAKQAPNQRYVARGRLDYWGQGTLVTVSS

SEQ ID NO: 929 - protein, 5 aa, Artificial Sequence
  Description of Artificial Sequence: Synthetic peptide
  DOM23h-271-137 vhCDR1
EYRMW

SEQ ID NO: 930 - protein, 17 aa, Artificial Sequence
  Description of Artificial Sequence: Synthetic peptide
  DOM23h-271-137 vhCDR2
AIEPIGHRTYYANSVRG

SEQ ID NO: 931 - protein, 15 aa, Artificial Sequence
  Description of Artificial Sequence: Synthetic peptide
  DOM23h-271-137 vhCDR3
QAPNQRYVARGRLDY

SEQ ID NO: 932 - protein, 122 aa, Artificial Sequence
  Description of Artificial Sequence: Synthetic polypeptide
  DOM23h-439-47 Variable heavy (vh) domain
EVQLLESGGGLVQPGGSLRLSCAASGFTFGTEQMWWVRQAPGKGLEFISRIDSPGGRTYYANSVKGRFTISRDNSKNTLYLQMNSLRAEDTAVYYCAKRRPTGVSGTFYDYWGQGTLVTVSS

SEQ ID NO: 933 - protein, 5 aa, Artificial Sequence
  Description of Artificial Sequence: Synthetic peptide
  DOM23h-439-47 vhCDR1
TEQMW

SEQ ID NO: 934 - protein, 17 aa, Artificial Sequence
  Description of Artificial Sequence: Synthetic peptide
  DOM23h-439-47 vhCDR2
RIDSPGGRTYYANSVKG

SEQ ID NO: 935 - protein, 13 aa, Artificial Sequence
  Description of Artificial Sequence: Synthetic peptide
  DOM23h-439-47 vhCDR3
RRPTGVSGTFYDY

SEQ ID NO: 936 - protein, 122 aa, Artificial Sequence
  Description of Artificial Sequence: Synthetic polypeptide
  DOM23h-439-48 Variable heavy (vh) domain
EVQLLESGGGLVQPGGSLRLSCAASGFTFGTEQMWWVRQAPGKGLEFISRIDSPGGRTYYANSVRGRFTISRDNSKNTLYLQMNSLRAEDTAVYYCAKRRPTGVSGTFYDYWGQGTLVTVSS

SEQ ID NO: 937 - protein, 5 aa, Artificial Sequence
  Description of Artificial Sequence: Synthetic peptide
  DOM23h-439-48 vhCDR1
TEQMW

SEQ ID NO: 938 - protein, 17 aa, Artificial Sequence
  Description of Artificial Sequence: Synthetic peptide
  DOM23h-439-48 vhCDR2
RIDSPGGRTYYANSVRG

SEQ ID NO: 939 - protein, 13 aa, Artificial Sequence
  Description of Artificial Sequence: Synthetic peptide
  DOM23h-439-48 vhCDR3
RRPTGVSGTFYDY

SEQ ID NO: 940 - protein, 5 aa, Artificial Sequence
  Description of Artificial Sequence: Synthetic peptide
  mAb C[PD-1]_H1.130 vhCDR1
SFGMH

SEQ ID NO: 941 - protein, 16 aa, Artificial Sequence
  Description of Artificial Sequence: Synthetic peptide
  mAb C[PD-1]_H1.130 vhCDR2
YISSGSSIIYYADSVK

SEQ ID NO: 942 - protein, 10 aa, Artificial Sequence
  Description of Artificial Sequence: Synthetic peptide
  mAb C[PD-1]_H1.130 vhCDR3
GGYLVWSPDY

SEQ ID NO: 943 - protein, 119 aa, Artificial Sequence
  Description of Artificial Sequence: Synthetic polypeptide
  mAb C[PD-1]_H1.132 Variable heavy (vh) domain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGWLVWSPDYWGQGTLVTVSS

SEQ ID NO: 944 - protein, 5 aa, Artificial Sequence
  Description of Artificial Sequence: Synthetic peptide
  mAb C[PD-1]_H1.132 vhCDR1
SFGMH

SEQ ID NO: 945 - protein, 17 aa, Artificial Sequence
  Description of Artificial Sequence: Synthetic peptide
  mAb C[PD-1]_H1.132 vhCDR2
YISSGSSIIYYADSVKG

SEQ ID NO: 946 - protein, 10 aa, Artificial Sequence
  Description of Artificial Sequence: Synthetic peptide
  mAb C[PD-1]_H1.132 vhCDR3
GGWLVWSPDY

SEQ ID NO: 947 - protein, 119 aa, Artificial Sequence
  Description of Artificial Sequence: Synthetic polypeptide
  mAb C[PD-1]_H1.152 Variable heavy (vh) domain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVLSPDYWGQGTLVTVSS

SEQ ID NO: 948 - protein, 5 aa, Artificial Sequence
  Description of Artificial Sequence: Synthetic peptide
  mAb C[PD-1]_H1.152 vhCDR1
SFGMH

SEQ ID NO: 949 - protein, 17 aa, Artificial Sequence
  Description of Artificial Sequence: Synthetic peptide
  mAb C[PD-1]_H1.152 vhCDR2
YISSGSSIIYYADSVKG

SEQ ID NO: 950 - protein, 10 aa, Artificial Sequence
  Description of Artificial Sequence: Synthetic peptide
  mAb C[PD-1]_H1.152 vhCDR3
GGRLVLSPDY

SEQ ID NO: 951 - protein, 119 aa, Artificial Sequence
  Description of Artificial Sequence: Synthetic polypeptide
  mAb C[PD-1]_H1.169 Variable heavy (vh) domain
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 952 - protein, 5 aa, Artificial Sequence
  Description of Artificial Sequence: Synthetic peptide
  mAb C[PD-1]_H1.169 vhCDR1
SLGMH

SEQ ID NO: 953 - protein, 17 aa, Artificial Sequence
  Description of Artificial Sequence: Synthetic peptide
  mAb C[PD-1]_H1.169 vhCDR2
YISGGSSIIYYADSVKG

SEQ ID NO: 954 - protein, 10 aa, Artificial Sequence
  Description of Artificial Sequence: Synthetic peptide
  mAb C[PD-1]_H1.169 vhCDR3
GGRLVWSPDY

SEQ ID NO: 955 - protein, 119 aa, Artificial Sequence
  Description of Artificial Sequence: Synthetic polypeptide
  mAb C[PD-1]_H1.75 Variable heavy (vh) domain
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSS

SEQ ID NO: 956 - protein, 5 aa, Artificial Sequence
  Description of Artificial Sequence: Synthetic peptide
  mAb C[PD-1]_H1.75 vhCDR1
SLGMH

SEQ ID NO: 957 - protein, 17 aa, Artificial Sequence
  Description of Artificial Sequence: Synthetic peptide
  mAb C[PD-1]_H1.75 vhCDR2
YISGGSSIIYYADSVKG

SEQ ID NO: 958 - protein, 10 aa, Artificial Sequence
  Description of Artificial Sequence: Synthetic peptide
  mAb C[PD-1]_H1.75 vhCDR3
GGWLVWSPDY

SEQ ID NO: 959 - protein, 119 aa, Artificial Sequence
  Description of Artificial Sequence: Synthetic polypeptide
  mAb C[PD-1]_H1.176 Variable heavy (vh) domain
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVFSPDYWGQGTLVTVSS

SEQ ID NO: 960 - protein, 5 aa, Artificial Sequence
  Description of Artificial Sequence: Synthetic peptide
  mAb C[PD-1]_H1.176 vhCDR1
SLGMH

SEQ ID NO: 961 - protein, 17 aa, Artificial Sequence
  Description of Artificial Sequence: Synthetic peptide
  mAb C[PD-1]_H1.176 vhCDR2
YISSGSSIIYYADSVKG

SEQ ID NO: 962 - protein, 10 aa, Artificial Sequence
  Description of Artificial Sequence: Synthetic peptide
  mAb C[PD-1]_H1.176 vhCDR3
GGRLVFSPDY

SEQ ID NO: 963 - protein, 119 aa, Artificial Sequence
  Description of Artificial Sequence: Synthetic polypeptide
  mAb C[PD-1]_H1.177 Variable heavy (vh) domain
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVFSPDYWGQGTLVTVSS

SEQ ID NO: 964 - protein, 5 aa, Artificial Sequence
  Description of Artificial Sequence: Synthetic peptide
  mAb C[PD-1]_H1.177 vhCDR1
SLGMH

SEQ ID NO: 965 - protein, 17 aa, Artificial Sequence
  Description of Artificial Sequence: Synthetic peptide
  mAb C[PD-1]_H1.177 vhCDR2
YISGGSSIIYYADSVKG

SEQ ID NO: 966 - protein, 10 aa, Artificial Sequence
  Description of Artificial Sequence: Synthetic peptide
  mAb C[PD-1]_H1.177 vhCDR3
GGRLVFSPDY

SEQ ID NO: 967 - protein, 119 aa, Artificial Sequence
  Description of Artificial Sequence: Synthetic polypeptide
  mAb C[PD-1]_H1.180 Variable heavy (vh) domain
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGELVFSPDYWGQGTLVTVSS

SEQ ID NO: 968 - protein, 5 aa, Artificial Sequence
  Description of Artificial Sequence: Synthetic peptide
  mAb C[PD-1]_H1.180 vhCDR1
SLGMH

SEQ ID NO: 969 - protein, 17 aa, Artificial Sequence
  Description of Artificial Sequence: Synthetic peptide
  mAb C[PD-1]_H1.180 vhCDR2
YISGGSSIIYYADSVKG

SEQ ID NO: 970 - protein, 10 aa, Artificial Sequence
  Description of Artificial Sequence: Synthetic peptide
  mAb C[PD-1]_H1.180 vhCDR3
GGELVFSPDY

SEQ ID NO: 971 - protein, 119 aa, Artificial Sequence
  Description of Artificial Sequence: Synthetic polypeptide
  mAb C[PD-1]_H2 Variable heavy (vh) domain
EVQLVESGGGLVKPGGSLRLSCAASGFTFSSFGMHWVRQAPGKGLEWVGYISSGSSIIYYADPVKGRFTISRDNSKNTLYLQMNSLKTEDTAVYYCARGGRLVWSPDYWGQGTLVTVSS

SEQ ID NO: 972 - protein, 5 aa, Artificial Sequence
  Description of Artificial Sequence: Synthetic peptide
  mAb C[PD-1]_H2 vhCDR1
SFGMH

SEQ ID NO: 973 - protein, 17 aa, Artificial Sequence
  Description of Artificial Sequence: Synthetic peptide
  mAb C[PD-1]_H2 vhCDR2
YISSGSSIIYYADPVKG

SEQ ID NO: 974 - protein, 10 aa, Artificial Sequence
  Description of Artificial Sequence: Synthetic peptide
  mAb C[PD-1]_H2 vhCDR3
GGRLVWSPDY

SEQ ID NO: 975 - protein, 113 aa, Artificial Sequence
  Description of Artificial Sequence: Synthetic polypeptide
  mAb C[PD-1]_L1 Variable light (vl) domain
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 976 - protein, 17 aa, Artificial Sequence
  Description of Artificial Sequence: Synthetic peptide
  mAb C[PD-1]_L1 vlCDR1
KSSQSLLNSGNQKNYLT

SEQ ID NO: 977 - protein, 7 aa, Artificial Sequence
  Description of Artificial Sequence: Synthetic peptide
  mAb C[PD-1]_L1 vlCDR2
WASTRES

SEQ ID NO: 978 - protein, 9 aa, Artificial Sequence
  Description of Artificial Sequence: Synthetic peptide
  mAb C[PD-1]_L1 vlCDR3
QNDYSYPFT

SEQ ID NO: 979 - protein, 113 aa, Artificial Sequence
  Description of Artificial Sequence: Synthetic polypeptide
  mAb C[PD-1]_L1.1 Variable light (vl) domain
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 980 - protein, 17 aa, Artificial Sequence
  Description of Artificial Sequence: Synthetic peptide
  mAb C[PD-1]_L1.1 vlCDR1
KSSQSLLHSGNQKNYLT

SEQ ID NO: 981 - protein, 7 aa, Artificial Sequence
  Description of Artificial Sequence: Synthetic peptide
  mAb C[PD-1]_L1.1 vlCDR2
WASTRES

SEQ ID NO: 982 - protein, 9 aa, Artificial Sequence
  Description of Artificial Sequence: Synthetic peptide
  mAb C[PD-1]_L1.1 vlCDR3
QNDYSYPFT

SEQ ID NO: 983 - protein, 113 aa, Artificial Sequence
  Description of Artificial Sequence: Synthetic polypeptide
  mAb C[PD-1]_L1.3 Variable light (vl) domain
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 984 - protein, 17 aa, Artificial Sequence
  Description of Artificial Sequence: Synthetic peptide
  mAb C[PD-1]_L1.3 vlCDR1
KSSQSLLSSGNQKNYLT

SEQ ID NO: 985 - protein, 7 aa, Artificial Sequence
  Description of Artificial Sequence: Synthetic peptide
  mAb C[PD-1]_L1.3 vlCDR2
WASTRES

SEQ ID NO: 986 - protein, 9 aa, Artificial Sequence
  Description of Artificial Sequence: Synthetic peptide
  mAb C[PD-1]_L1.3 vlCDR3
QNDYSYPFT

SEQ ID NO: 987 - protein, 113 aa, Artificial Sequence
  Description of Artificial Sequence: Synthetic polypeptide
  mAb C[PD-1]_L1.45 Variable light (vl) domain
DIVMTQSPDSLAVSLGERATINCKSSQSLLNSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 988 - protein, 17 aa, Artificial Sequence
  Description of Artificial Sequence: Synthetic peptide
  mAb C[PD-1]_L1.45 vlCDR1
KSSQSLLNSGNQYNYLT

SEQ ID NO: 989 - protein, 7 aa, Artificial Sequence
  Description of Artificial Sequence: Synthetic peptide
  mAb C[PD-1]_L1.45 vlCDR2
WASTRES

SEQ ID NO: 990 - protein, 122 aa, Artificial Sequence
  Description of Artificial Sequence: Synthetic polypeptide
  Merus VH 1 Variable heavy (vh) domain
EVQLVESGGGLVQPGGSLRLSCAASGFTFDIYAMTWVRQAPGKGLEWVSVISGSGGTTYYADSVKGRFTISRDNSKNTLYLQMNSLRAEDTAVYYCARRGQYRDIVGATDYWGQGTLVTVSS

SEQ ID NO: 991 - protein, 5 aa, Artificial Sequence
  Description of Artificial Sequence: Synthetic peptide
  Merus VH 1 vhCDR1
IYAMT

SEQ ID NO: 992 - protein, 17 aa, Artificial Sequence
  Description of Artificial Sequence: Synthetic peptide
  Merus VH 1 vhCDR2
VISGSGGTTYYADSVKG

SEQ ID NO: 993 - protein, 13 aa, Artificial Sequence
  Description of Artificial Sequence: Synthetic peptide
  Merus VH 1 vhCDR3
RGQYRDIVGATDY

SEQ ID NO: 994 - protein, 116 aa, Artificial Sequence
  Description of Artificial Sequence: Synthetic polypeptide
  Merus VH 2 Variable heavy (vh) domain
QVQLVESGGGLVEPGGSLRLSCAASGFTFSNAWMSWVRQAPGKGLEWVGRIKTTISGGATDFAAPVKGRFTISRDDSKNTLYLQMNSLKTEDTAVYYCTLDLRDYWGQGTLVTVSS

SEQ ID NO: 995 - protein, 5 aa, Artificial Sequence
  Description of Artificial Sequence: Synthetic peptide
  Merus VH 2 vhCDR1
NAWMS

SEQ ID NO: 996 - protein, 19 aa, Artificial Sequence
  Description of Artificial Sequence: Synthetic peptide
  Merus VH 2 vhCDR2
RIKTTISGGATDFAAPVKG

SEQ ID NO: 997 - protein, 5 aa, Artificial Sequence
  Description of Artificial Sequence: Synthetic peptide
  Merus VH 2 vhCDR3
DLRDY

SEQ ID NO: 998 - protein, 121 aa, Artificial Sequence
  Description of Artificial Sequence: Synthetic polypeptide
  Merus VH 3 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGIAASGKNYFDPWGQGTLVTVSS

SEQ ID NO: 999 - protein, 5 aa, Artificial Sequence
  Description of Artificial Sequence: Synthetic peptide
  Merus VH 3 vhCDR1
RYAMS

SEQ ID NO: 1000 - protein, 17 aa, Artificial Sequence
  Description of Artificial Sequence: Synthetic peptide
  Merus VH 3 vhCDR2
AISASGDRTHNTDSVKG

SEQ ID NO: 1001 - protein, 12 aa, Artificial Sequence
  Description of Artificial Sequence: Synthetic peptide
  Merus VH 3 vhCDR3
GIAASGKNYFDP

SEQ ID NO: 1002 - protein, 122 aa, Artificial Sequence
  Description of Artificial Sequence: Synthetic polypeptide
  Merus VH 4 Variable heavy (vh) domain
EVQLVESGGGLVQPGGSLRLSCAASGFTFDINAMTWVRQAPGKGLEWVSVISGSGGTTYYADSVKGRFTISRDNSKNTLYLQMNSLRAEDTAVYYCARRGQYRDIVGATDYWGQGTLVTVSS

SEQ ID NO: 1003 - protein, 5 aa, Artificial Sequence
  Description of Artificial Sequence: Synthetic peptide
  Merus VH 4 vhCDR1
INAMT

SEQ ID NO: 1004 - protein, 17 aa, Artificial Sequence
  Description of Artificial Sequence: Synthetic peptide
  Merus VH 4 vhCDR2
VISGSGGTTYYADSVKG

SEQ ID NO: 1005 - protein, 13 aa, Artificial Sequence
  Description of Artificial Sequence: Synthetic peptide
  Merus VH 4 vhCDR3
RGQYRDIVGATDY

SEQ ID NO: 1006 - protein, 122 aa, Artificial Sequence
  Description of Artificial Sequence: Synthetic polypeptide
  Merus VH 5 Variable heavy (vh) domain
EVQLVESGGGLVQPGGSLRLSCAASGFTFDIQAMTWVRQAPGKGLEWVSVISGSGGTTYYADSVQGRFTISRDNSKNTLYLQMNSLRAEDTAVYYCARRGQYRDIVGATDYWGQGTLVTVSS

SEQ ID NO: 1007 - protein, 5 aa, Artificial Sequence
  Description of Artificial Sequence: Synthetic peptide
  Merus VH 5 vhCDR1
IQAMT

SEQ ID NO: 1008 - protein, 17 aa, Artificial Sequence
  Description of Artificial Sequence: Synthetic peptide
  Merus VH 5 vhCDR2
VISGSGGTTYYADSVQG

SEQ ID NO: 1009 - protein, 13 aa, Artificial Sequence
  Description of Artificial Sequence: Synthetic peptide
  Merus VH 5 vhCDR3
RGQYRDIVGATDY

SEQ ID NO: 1010 - protein, 122 aa, Artificial Sequence
  Description of Artificial Sequence: Synthetic polypeptide
  Merus VH 6 Variable heavy (vh) domain
EVQLVESGGGLVQPGGSLRLSCAASGFTFDIYRMTWVRQAPGKGLEWVSVISGSGGTTYYADSVKGRFTISRDNSKNTLYLQMNSLRAEDTAVYYCARQGQYREIVGATDYWGQGTLVTVSS

SEQ ID NO: 1011 - protein, 5 aa, Artificial Sequence
  Description of Artificial Sequence: Synthetic peptide
  Merus VH 6 vhCDR1
IYRMT

SEQ ID NO: 1012 - protein, 17 aa, Artificial Sequence
  Description of Artificial Sequence: Synthetic peptide
  Merus VH 6 vhCDR2
VISGSGGTTYYADSVKG

SEQ ID NO: 1013 - protein, 13 aa, Artificial Sequence
  Description of Artificial Sequence: Synthetic peptide
  Merus VH 6 vhCDR3
QGQYREIVGATDY

SEQ ID NO: 1014 - protein, 122 aa, Artificial Sequence
  Description of Artificial Sequence: Synthetic polypeptide
  Merus VH 7 Variable heavy (vh) domain
EVQLVESGGGLVQPGGSLRLSCAASGFYFDIYAMTWVRQAPGKGLEWVSVISGSGGTTYYADSVKGRFTISRDNSKNTLYLQMNSLRAEDTAVYYCARRSQYRDKVGATDYWGQGTLVTVSS

SEQ ID NO: 1015 - protein, 5 aa, Artificial Sequence
  Description of Artificial Sequence: Synthetic peptide
  Merus VH 7 vhCDR1
IYAMT

SEQ ID NO: 1016 - protein, 17 aa, Artificial Sequence
  Description of Artificial Sequence: Synthetic peptide
  Merus VH 7 vhCDR2
VISGSGGTTYYADSVKG

SEQ ID NO: 1017 - protein, 13 aa, Artificial Sequence
  Description of Artificial Sequence: Synthetic peptide
  Merus VH 7 vhCDR3
RSQYRDKVGATDY

SEQ ID NO: 1018 - protein, 122 aa, Artificial Sequence
  Description of Artificial Sequence: Synthetic polypeptide
  Merus VH 8 Variable heavy (vh) domain
EVQLVESGGGLVQPGGSLRLSCAASGFTFDINAMTWVRQAPGKGLEWVSVISGSGGTTYYADSVKGRFTISRDNSKNTLYLQMNSLRAEDTAVYYCARRGQYREIAGATDYWGQGTLVTVSS

SEQ ID NO: 1019 - protein, 5 aa, Artificial Sequence
  Description of Artificial Sequence: Synthetic peptide
  Merus VH 8 vhCDR1
INAMT

SEQ ID NO: 1020 - protein, 17 aa, Artificial Sequence
  Description of Artificial Sequence: Synthetic peptide
  Merus VH 8 vhCDR2
VISGSGGTTYYADSVKG

SEQ ID NO: 1021 - protein, 13 aa, Artificial Sequence
  Description of Artificial Sequence: Synthetic peptide
  Merus VH 8 vhCDR3
RGQYREIAGATDY

SEQ ID NO: 1022 - protein, 122 aa, Artificial Sequence
  Description of Artificial Sequence: Synthetic polypeptide
  Merus VH 9 Variable heavy (vh) domain
EVQLVESGGGLVQPGGSLRLSCAASGFAFDIYAMTWVRQAPGKGLEWVSVISGSGGTIYYADSVKGRFTISRDNSKNTLYLQMNSLRAEDTAVYYCARRGQYRDIVGATDYWGQGTLVTVSS

SEQ ID NO: 1023 - protein, 5 aa, Artificial Sequence
  Description of Artificial Sequence: Synthetic peptide
  Merus VH 9 vhCDR1
IYAMT

SEQ ID NO: 1024 - protein, 17 aa, Artificial Sequence
  Description of Artificial Sequence: Synthetic peptide
  Merus VH 9 vhCDR2
VISGSGGTIYYADSVKG

SEQ ID NO: 1025 - protein, 13 aa, Artificial Sequence
  Description of Artificial Sequence: Synthetic peptide
  Merus VH 9 vhCDR3
RGQYRDIVGATDY

SEQ ID NO: 1026 - protein, 122 aa, Artificial Sequence
  Description of Artificial Sequence: Synthetic polypeptide
  Merus VH 10 Variable heavy (vh) domain
EVQLVESGGGLVQPGGSLRLSCAASGFTFDIYAMTWVRQAPGKGLEWVSVISGSGGTVYYADSVKGRFTISRDNSKNTLYLQMNSLRAEDTAVYYCARRGQYRDIAGGTDYWGQGTLVTVSS

SEQ ID NO: 1027 - protein, 5 aa, Artificial Sequence
  Description of Artificial Sequence: Synthetic peptide
  Merus VH 10 vhCDR1
IYAMT

SEQ ID NO: 1028 - protein, 17 aa, Artificial Sequence
  Description of Artificial Sequence: Synthetic peptide
  Merus VH 10 vhCDR2
VISGSGGTVYYADSVKG

SEQ ID NO: 1029 - protein, 13 aa, Artificial Sequence
  Description of Artificial Sequence: Synthetic peptide
  Merus VH 10 vhCDR3
RGQYRDIAGGTDY

SEQ ID NO: 1030 - protein, 122 aa, Artificial Sequence
  Description of Artificial Sequence: Synthetic polypeptide
  Merus VH 11 Variable heavy (vh) domain
EVQLVESGGGLVQPGGSLRLSCAASGFDFDIYAMTWVRQAPGKGLEWVSVISGSGGTTYYADSVKGRFTISRDNSKNTLYLQMNSLRAEDTAVYYCARRSQYRDKVGATDYWGQGTLVTVSS

SEQ ID NO: 1031 - protein, 5 aa, Artificial Sequence
  Description of Artificial Sequence: Synthetic peptide
  Merus VH 11 vhCDR1
IYAMT

SEQ ID NO: 1032 - protein, 17 aa, Artificial Sequence
  Description of Artificial Sequence: Synthetic peptide
  Merus VH 11 vhCDR2
VISGSGGTTYYADSVKG

SEQ ID NO: 1033 - protein, 13 aa, Artificial Sequence
  Description of Artificial Sequence: Synthetic peptide
  Merus VH 11 vhCDR3
RSQYRDKVGATDY

SEQ ID NO: 1034 - protein, 122 aa, Artificial Sequence
  Description of Artificial Sequence: Synthetic polypeptide
  Merus VH 12 Variable heavy (vh) domain
EVQLVESGGGLVQPGGSLRLSCAASGFRFDIYAMTWVRQAPGKGLEWVSVISGSGGTTYYADSVKGRFTISRDNSKNTLYLQMNSLRAEDTAVYYCARRGQYRRIVGATDYWGQGTLVTVSS

SEQ ID NO: 1035 - protein, 5 aa, Artificial Sequence
  Description of Artificial Sequence: Synthetic peptide
  Merus VH 12 vhCDR1
IYAMT

SEQ ID NO: 1036 - protein, 17 aa, Artificial Sequence
  Description of Artificial Sequence: Synthetic peptide
  Merus VH 12 vhCDR2
VISGSGGTTYYADSVKG

SEQ ID NO: 1037 - protein, 13 aa, Artificial Sequence
  Description of Artificial Sequence: Synthetic peptide
  Merus VH 12 vhCDR3
RGQYRRIVGATDY

SEQ ID NO: 1038 - protein, 122 aa, Artificial Sequence
  Description of Artificial Sequence: Synthetic polypeptide
  Merus VH 13 Variable heavy (vh) domain
EVQLVESGGGLVQPGGSLRLSCAASGFTFDINAMTWVRQAPGKGLEWVSVISGSGGTTAYADSVKGRFTISRDNSKNTLYLQMNSLRAEDTAVYYCARRGQYRYIAGATDYWGQGTLVTVSS

SEQ ID NO: 1039 - protein, 5 aa, Artificial Sequence
  Description of Artificial Sequence: Synthetic peptide
  Merus VH 13 vhCDR1
INAMT

SEQ ID NO: 1040 - protein, 17 aa, Artificial Sequence
  Description of Artificial Sequence: Synthetic peptide
  Merus VH 13 vhCDR2
VISGSGGTTAYADSVKG

SEQ ID NO: 1041 - protein, 13 aa, Artificial Sequence
  Description of Artificial Sequence: Synthetic peptide
  Merus VH 13 vhCDR3
RGQYRYIAGATDY

SEQ ID NO: 1042 - protein, 122 aa, Artificial Sequence
  Description of Artificial Sequence: Synthetic polypeptide
  Merus VH 14 Variable heavy (vh) domain
EVQLVESGGGLVQPGGSLRLSCAASGFTFDITAMTWVRQAPGKGLEWVSVISGSGGTTYYADSVKGRFTISRDNSKNTLYLQMNSLRAEDTAVYYCARRGQYRDIAGATDYWGQGTLVTVSS

SEQ ID NO: 1043 - protein, 5 aa, Artificial Sequence
  Description of Artificial Sequence: Synthetic peptide
  Merus VH 14 vhCDR1
ITAMT

SEQ ID NO: 1044 - protein, 17 aa, Artificial Sequence
  Description of Artificial Sequence: Synthetic peptide
  Merus VH 14 vhCDR2
VISGSGGTTYYADSVKG

SEQ ID NO: 1045 - protein, 13 aa, Artificial Sequence
  Description of Artificial Sequence: Synthetic peptide
  Merus VH 14 vhCDR3
RGQYRDIAGATDY

SEQ ID NO: 1046 - protein, 122 aa, Artificial Sequence
  Description of Artificial Sequence: Synthetic polypeptide
  Merus VH 15 Variable heavy (vh) domain
EVQLVESGGGLVQPGGSLRLSCAASGFSFDIYAMTWVRQAPGKGLEWVSVISGSGGTTYYADSVKGRFTISRDNSKNTLYLQMNSLRAEDTAVYYCARRAQYRDKVGATDYWGQGTLVTVSS

SEQ ID NO: 1047 - protein, 5 aa, Artificial Sequence
  Description of Artificial Sequence: Synthetic peptide
  Merus VH 15 vhCDR1
IYAMT

SEQ ID NO: 1048 - protein, 17 aa, Artificial Sequence
  Description of Artificial Sequence: Synthetic peptide
  Merus VH 15 vhCDR2
VISGSGGTTYYADSVKG

SEQ ID NO: 1049 - protein, 13 aa, Artificial Sequence
  Description of Artificial Sequence: Synthetic peptide
  Merus VH 15 vhCDR3
RAQYRDKVGATDY

SEQ ID NO: 1050 - protein, 122 aa, Artificial Sequence
  Description of Artificial Sequence: Synthetic polypeptide
  Merus VH 16 Variable heavy (vh) domain
EVQLVESGGGLVQPGGSLRLSCAASGFTFDIYAMTWVRQAPGKGLEWVSVISGSGGTTYYADSVKGRFTISRDNSKNTLYLQMNSLRAEDTAVYYCARRGQYRYVVGATDYWGQGTLVTVSS

SEQ ID NO: 1051 - protein, 5 aa, Artificial Sequence
  Description of Artificial Sequence: Synthetic peptide
  Merus VH 16 vhCDR1
IYAMT

SEQ ID NO: 1052 - protein, 17 aa, Artificial Sequence
  Description of Artificial Sequence: Synthetic peptide
  Merus VH 16 vhCDR2
VISGSGGTTYYADSVKG

SEQ ID NO: 1053 - protein, 13 aa, Artificial Sequence
  Description of Artificial Sequence: Synthetic peptide
  Merus VH 16 vhCDR3
RGQYRYVVGATDY

SEQ ID NO: 1054 - protein, 122 aa, Artificial Sequence
  Description of Artificial Sequence: Synthetic polypeptide
  Merus VH 17 Variable heavy (vh) domain
EVQLVESGGGLVQPGGSLRLSCAASGFYFDIYAMTWVRQAPGKGLEWVSVISGSGGTTYYADSVKGRFTISRDNSKNTLYLQMNSLRAEDTAVYYCARRGQYRHIAGATDYWGQGTLVTVSS

SEQ ID NO: 1055 - protein, 5 aa, Artificial Sequence
  Description of Artificial Sequence: Synthetic peptide
  Merus VH 17 vhCDR1
IYAMT

SEQ ID NO: 1056 - protein, 17 aa, Artificial Sequence
  Description of Artificial Sequence: Synthetic peptide
  Merus VH 17 vhCDR2
VISGSGGTTYYADSVKG

SEQ ID NO: 1057 - protein, 13 aa, Artificial Sequence
  Description of Artificial Sequence: Synthetic peptide
  Merus VH 17 vhCDR3
RGQYRHIAGATDY

SEQ ID NO: 1058 - protein, 122 aa, Artificial Sequence
  Description of Artificial Sequence: Synthetic polypeptide
  Merus VH 18 Variable heavy (vh) domain
EVQLVESGGGLVQPGGSLRLSCAASGFRFDIYAMTWVRQAPGKGLEWVSVISGSGGTTYYADSVKGRFTISRDNSKNTLYLQMNSLRAEDTAVYYCARRGQYRDIVGATDYWGQGTLVTVSS

SEQ ID NO: 1059 - protein, 5 aa, Artificial Sequence
  Description of Artificial Sequence: Synthetic peptide
  Merus VH 18 vhCDR1
IYAMT

SEQ ID NO: 1060 - protein, 17 aa, Artificial Sequence
  Description of Artificial Sequence: Synthetic peptide
  Merus VH 18 vhCDR2
VISGSGGTTYYADSVKG

SEQ ID NO: 1061 - protein, 13 aa, Artificial Sequence
  Description of Artificial Sequence: Synthetic peptide
  Merus VH 18 vhCDR3
RGQYRDIVGATDY

SEQ ID NO: 1062 - protein, 122 aa, Artificial Sequence
  Description of Artificial Sequence: Synthetic polypeptide
  Merus VH 19 Variable heavy (vh) domain
EVQLVESGGGLVQPGGSLRLSCAASGFTFDINAMTWVRQAPGKGLEWVSVISGSGATTYYADSVKGRFTISRDNSKNTLYLQMNSLRAEDTAVYYCARRGQYREIQGANDYWGQGTLVTVSS

SEQ ID NO: 1063 - protein, 5 aa, Artificial Sequence
  Description of Artificial Sequence: Synthetic peptide
  Merus VH 19 vhCDR1
INAMT

SEQ ID NO: 1064 - protein, 17 aa, Artificial Sequence
  Description of Artificial Sequence: Synthetic peptide
  Merus VH 19 vhCDR2
VISGSGATTYYADSVKG

SEQ ID NO: 1065 - protein, 13 aa, Artificial Sequence
  Description of Artificial Sequence: Synthetic peptide
  Merus VH 19 vhCDR3
RGQYREIQGANDY

SEQ ID NO: 1066 - protein, 116 aa, Artificial Sequence
  Description of Artificial Sequence: Synthetic polypeptide
  Merus VH 20 Variable heavy (vh) domain
QVQLVESGGGLVEPGGSLRLSCAASGFTFSRAWMSWVRQAPGKGLEWVGRIKTTISGGATQFAAPVKGRFTISRDDSKNTLYLQMNSLKTEDTAVYYCTLDLRNYWGQGTLVTVSS

SEQ ID NO: 1067 - protein, 5 aa, Artificial Sequence
  Description of Artificial Sequence: Synthetic peptide
  Merus VH 20 vhCDR1
RAWMS

SEQ ID NO: 1068 - protein, 19 aa, Artificial Sequence
  Description of Artificial Sequence: Synthetic peptide
  Merus VH 20 vhCDR2
RIKTTISGGATQFAAPVKG

SEQ ID NO: 1069 - protein, 5 aa, Artificial Sequence
  Description of Artificial Sequence: Synthetic peptide
  Merus VH 20 vhCDR3
DLRNY

SEQ ID NO: 1070 - protein, 116 aa, Artificial Sequence
  Description of Artificial Sequence: Synthetic polypeptide
  Merus VH 21 Variable heavy (vh) domain
QVQLVESGGGLVEPGGSLRLSCAASGFTFSRAWMSWVRQAPGKGLEWVGRIKTTVSGGATAFAAPVKGRFTISRDDSKNTLYLQMNSLKTEDTAVYYCTLDLRAYWGQGTLVTVSS

SEQ ID NO: 1071 - protein, 5 aa, Artificial Sequence
  Description of Artificial Sequence: Synthetic peptide
  Merus VH 21 vhCDR1
RAWMS

SEQ ID NO: 1072 - protein, 19 aa, Artificial Sequence
  Description of Artificial Sequence: Synthetic peptide
  Merus VH 21 vhCDR2
RIKTTVSGGATAFAAPVKG

SEQ ID NO: 1073 - protein, 5 aa, Artificial Sequence
  Description of Artificial Sequence: Synthetic peptide
  Merus VH 21 vhCDR3
DLRAY

SEQ ID NO: 1074 - protein, 116 aa, Artificial Sequence
  Description of Artificial Sequence: Synthetic polypeptide
  Merus VH 22 Variable heavy (vh) domain
QVQLVESGGGLVEPGGSLRLSCAASGFTFSNYWMSWVRQAPGKGLEWVGRIKTTYSGGATDFAAPVKGRFTISRDDSKNTLYLQMNSLKTEDTAVYYCTLDLRDYWGQGTLVTVSS

SEQ ID NO: 1075 - protein, 5 aa, Artificial Sequence
  Description of Artificial Sequence: Synthetic peptide
  Merus VH 22 vhCDR1
NYWMS

SEQ ID NO: 1076 - protein, 19 aa, Artificial Sequence
  Description of Artificial Sequence: Synthetic peptide
  Merus VH 22 vhCDR2
RIKTTYSGGATDFAAPVKG

SEQ ID NO: 1077 - protein, 5 aa, Artificial Sequence
  Description of Artificial Sequence: Synthetic peptide
  Merus VH 22 vhCDR3
DLRDY

SEQ ID NO: 1078 - protein, 116 aa, Artificial Sequence
  Description of Artificial Sequence: Synthetic polypeptide
  Merus VH 23 Variable heavy (vh) domain
QVQLVESGGGLVEPGGSLRLSCAASGFTFSRAWMSWVRQAPGKGLEWVGRIKTTYSGGATDFAAPVKGRFTISRDDSKNTLYLQMNSLKTEDTAVYYCTLDLRKYWGQGTLVTVSS

SEQ ID NO: 1079 - protein, 5 aa, Artificial Sequence
  Description of Artificial Sequence: Synthetic peptide
  Merus VH 23 vhCDR1
RAWMS

SEQ ID NO: 1080 - protein, 19 aa, Artificial Sequence
  Description of Artificial Sequence: Synthetic peptide
  Merus VH 23 vhCDR2
RIKTTYSGGATDFAAPVKG

SEQ ID NO: 1081 - protein, 5 aa, Artificial Sequence
  Description of Artificial Sequence: Synthetic peptide
  Merus VH 23 vhCDR3
DLRKY

SEQ ID NO: 1082 - protein, 116 aa, Artificial Sequence
  Description of Artificial Sequence: Synthetic polypeptide
  Merus VH 24 Variable heavy (vh) domain
QVQLVESGGGLVEPGGSLRLSCAASGFTFSRAWMSWVRQAPGKGLEWVGRIKTTISGGATDFAAPVKGRFTISRDDSKNTLYLQMNSLKTEDTAVYYCTLDLRAYWGQGTLVTVSS

SEQ ID NO: 1083 - protein, 5 aa, Artificial Sequence
  Description of Artificial Sequence: Synthetic peptide
  Merus VH 24 vhCDR1
RAWMS

SEQ ID NO: 1084 - protein, 19 aa, Artificial Sequence
  Description of Artificial Sequence: Synthetic peptide
  Merus VH 24 vhCDR2
RIKTTISGGATDFAAPVKG

SEQ ID NO: 1085 - protein, 5 aa, Artificial Sequence
  Description of Artificial Sequence: Synthetic peptide
  Merus VH 24 vhCDR3
DLRAY

SEQ ID NO: 1086 - protein, 116 aa, Artificial Sequence
  Description of Artificial Sequence: Synthetic polypeptide
  Merus VH 25 Variable heavy (vh) domain
QVQLVESGGGLVEPGGSLRLSCAASGFKFSNAWMSWVRQAPGKGLEWVGRIKTTISGGATQFAAPVKGRFTISRDDSKNTLYLQMNSLKTEDTAVYYCTLDLRDYWGQGTLVTVSS

SEQ ID NO: 1087 - protein, 5 aa, Artificial Sequence
  Description of Artificial Sequence: Synthetic peptide
  Merus VH 25 vhCDR1
NAWMS

SEQ ID NO: 1088 - protein, 19 aa, Artificial Sequence
  Description of Artificial Sequence: Synthetic peptide
  Merus VH 25 vhCDR2
RIKTTISGGATQFAAPVKG

SEQ ID NO: 1089 - protein, 5 aa, Artificial Sequence
  Description of Artificial Sequence: Synthetic peptide
  Merus VH 25 vhCDR3
DLRDY

SEQ ID NO: 1090 - protein, 116 aa, Artificial Sequence
  Description of Artificial Sequence: Synthetic polypeptide
  Merus VH 26 Variable heavy (vh) domain
QVQLVESGGGLVEPGGSLRLSCAASGFTFSNAWMSWVRQAPGKGLEWVGRIKTTYSGGATDFAAPVKGRFTISRDDSKNTLYLQMNSLKTEDTAVYYCTLDLRDYWGQGTLVTVSS

SEQ ID NO: 1091 - protein, 5 aa, Artificial Sequence
  Description of Artificial Sequence: Synthetic peptide
  Merus VH 26 vhCDR1
NAWMS

SEQ ID NO: 1092 - protein, 19 aa, Artificial Sequence
  Description of Artificial Sequence: Synthetic peptide
  Merus VH 26 vhCDR2
RIKTTYSGGATDFAAPVKG

SEQ ID NO: 1093 - protein, 5 aa, Artificial Sequence
  Description of Artificial Sequence: Synthetic peptide
  Merus VH 26 vhCDR3
DLRDY

SEQ ID NO: 1094 - protein, 116 aa, Artificial Sequence
  Description of Artificial Sequence: Synthetic polypeptide
  Merus VH 27 Variable heavy (vh) domain
QVQLVESGGGLVEPGGSLRLSCAASGFTFSNAWMSWVRQAPGKGLEWVGRIKTTYSGGATEFAAPVKGRFTISRDDSKNTLYLQMNSLKTEDTAVYYCTLDLRKYWGQGTLVTVSS

SEQ ID NO: 1095 - protein, 5 aa, Artificial Sequence
  Description of Artificial Sequence: Synthetic peptide
  Merus VH 27 vhCDR1
NAWMS

SEQ ID NO: 1096 - protein, 19 aa, Artificial Sequence
  Description of Artificial Sequence: Synthetic peptide
  Merus VH 27 vhCDR2
RIKTTYSGGATEFAAPVKG

SEQ ID NO: 1097 - protein, 5 aa, Artificial Sequence
  Description of Artificial Sequence: Synthetic peptide
  Merus VH 27 vhCDR3
DLRKY

SEQ ID NO: 1098 - protein, 116 aa, Artificial Sequence
  Description of Artificial Sequence: Synthetic polypeptide
  Merus VH 28 Variable heavy (vh) domain
QVQLVESGGGLVEPGGSLRLSCAASGFTFSNYWMSWVRQAPGKGLEWVGRIKTTISGGATDFAAPVKGRFTISRDDSKNTLYLQMNSLKTEDTAVYYCTLDLRAYWGQGTLVTVSS

SEQ ID NO: 1099 - protein, 5 aa, Artificial Sequence
  Description of Artificial Sequence: Synthetic peptide
  Merus VH 28 vhCDR1
NYWMS

SEQ ID NO: 1100 - protein, 19 aa, Artificial Sequence
  Description of Artificial Sequence: Synthetic peptide
  Merus VH 28 vhCDR2
RIKTTISGGATDFAAPVKG

SEQ ID NO: 1101 - protein, 5 aa, Artificial Sequence
  Description of Artificial Sequence: Synthetic peptide
  Merus VH 28 vhCDR3
DLRAY

SEQ ID NO: 1102 - protein, 116 aa, Artificial Sequence
  Description of Artificial Sequence: Synthetic polypeptide
  Merus VH 29 Variable heavy (vh) domain
QVQLVESGGGLVEPGGSLRLSCAASGFTFSRAWMSWVRQAPGKGLEWVGRIKTTISGAATDFAAPVKGRFTISRDDSKNTLYLQMNSLKTEDTAVYYCTLDLRDYWGQGTLVTVSS

SEQ ID NO: 1103 - protein, 5 aa, Artificial Sequence
  Description of Artificial Sequence: Synthetic peptide
  Merus VH 29 vhCDR1
RAWMS

SEQ ID NO: 1104 - protein, 19 aa, Artificial Sequence
  Description of Artificial Sequence: Synthetic peptide
  Merus VH 29 vhCDR2
RIKTTISGAATDFAAPVKG

SEQ ID NO: 1105 - protein, 5 aa, Artificial Sequence
  Description of Artificial Sequence: Synthetic peptide
  Merus VH 29 vhCDR3
DLRDY

SEQ ID NO: 1106 - protein, 116 aa, Artificial Sequence
  Description of Artificial Sequence: Synthetic polypeptide
  Merus VH 30 Variable heavy (vh) domain
QVQLVESGGGLVEPGGSLRLSCAASGFTFANAWMSWVRQAPGKGLEWVGRIKTTYSGGATDFAAPVKGRFTISRDDSKNTLYLQMNSLKTEDTAVYYCTLDLRKYWGQGTLVTVSS

SEQ ID NO: 1107 - protein, 5 aa, Artificial Sequence
  Description of Artificial Sequence: Synthetic peptide
  Merus VH 30 vhCDR1
NAWMS

SEQ ID NO: 1108 - protein, 19 aa, Artificial Sequence
  Description of Artificial Sequence: Synthetic peptide
  Merus VH 30 vhCDR2
RIKTTYSGGATDFAAPVKG

SEQ ID NO: 1109 - protein, 5 aa, Artificial Sequence
  Description of Artificial Sequence: Synthetic peptide
  Merus VH 30 vhCDR3
DLRKY

SEQ ID NO: 1110 - protein, 116 aa, Artificial Sequence
  Description of Artificial Sequence: Synthetic polypeptide
  Merus VH 31 Variable heavy (vh) domain
QVQLVESGGGLVEPGGSLRLSCAASGFQFSNAWMSWVRQAPGKGLEWVGRIKTTYSGGATDFAAPVKGRFTISRDDSKNTLYLQMNSLKTEDTAVYYCTLDLRDYWGQGTLVTVSS

SEQ ID NO: 1111 - protein, 5 aa, Artificial Sequence
  Description of Artificial Sequence: Synthetic peptide
  Merus VH 31 vhCDR1
NAWMS

SEQ ID NO: 1112 - protein, 19 aa, Artificial Sequence
  Description of Artificial Sequence: Synthetic peptide
  Merus VH 31 vhCDR2
RIKTTYSGGATDFAAPVKG

SEQ ID NO: 1113 - protein, 5 aa, Artificial Sequence
  Description of Artificial Sequence: Synthetic peptide
  Merus VH 31 vhCDR3
DLRDY

SEQ ID NO: 1114 - protein, 116 aa, Artificial Sequence
  Description of Artificial Sequence: Synthetic polypeptide
  Merus VH 32 Variable heavy (vh) domain
QVQLVESGGGLVEPGGSLRLSCAASGFTFSNAHMSWVRQAPGKGLEWVGRIKTTYSGGATDFAAPVKGRFTISRDDSKNTLYLQMNSLKTEDTAVYYCTLDLRQYWGQGTLVTVSS

SEQ ID NO: 1115 - protein, 5 aa, Artificial Sequence
  Description of Artificial Sequence: Synthetic peptide
  Merus VH 32 vhCDR1
NAHMS

SEQ ID NO: 1116 - protein, 19 aa, Artificial Sequence
  Description of Artificial Sequence: Synthetic peptide
  Merus VH 32 vhCDR2
RIKTTYSGGATDFAAPVKG

SEQ ID NO: 1117 - protein, 5 aa, Artificial Sequence
  Description of Artificial Sequence: Synthetic peptide
  Merus VH 32 vhCDR3
DLRQY

SEQ ID NO: 1118 - protein, 116 aa, Artificial Sequence
  Description of Artificial Sequence: Synthetic polypeptide
  Merus VH 33 Variable heavy (vh) domain
QVQLVESGGGLVEPGGSLRLSCAASGFTFANAWMSWVRQAPGKGLEWVGRIKTTYSGGATEFAAPVKGRFTISRDDSKNTLYLQMNSLKTEDTAVYYCTLDLRTYWGQGTLVTVSS

SEQ ID NO: 1119 - protein, 5 aa, Artificial Sequence
  Description of Artificial Sequence: Synthetic peptide
  Merus VH 33 vhCDR1
NAWMS

SEQ ID NO: 1120 - protein, 19 aa, Artificial Sequence
  Description of Artificial Sequence: Synthetic peptide
  Merus VH 33 vhCDR2
RIKTTYSGGATEFAAPVKG

SEQ ID NO: 1121 - protein, 5 aa, Artificial Sequence
  Description of Artificial Sequence: Synthetic peptide
  Merus VH 33 vhCDR3
DLRTY

SEQ ID NO: 1122 - protein, 116 aa, Artificial Sequence
  Description of Artificial Sequence: Synthetic polypeptide
  Merus VH 34 Variable heavy (vh) domain
QVQLVESGGGLVEPGGSLRLSCAASGFTFSNAWMSWVRQAPGKGLEWVGRIKTTYSGGATDFAAPVKGRFTISRDDSKNTLYLQMNSLKTEDTAVYYCTLDLRSYWGQGTLVTVSS

SEQ ID NO: 1123 - protein, 5 aa, Artificial Sequence
  Description of Artificial Sequence: Synthetic peptide
  Merus VH 34 vhCDR1
NAWMS

SEQ ID NO: 1124 - protein, 19 aa, Artificial Sequence
  Description of Artificial Sequence: Synthetic peptide
  Merus VH 34 vhCDR2
RIKTTYSGGATDFAAPVKG

SEQ ID NO: 1125 - protein, 5 aa, Artificial Sequence
  Description of Artificial Sequence: Synthetic peptide
  Merus VH 34 vhCDR3
DLRSY

SEQ ID NO: 1126 - protein, 116 aa, Artificial Sequence
  Description of Artificial Sequence: Synthetic polypeptide
  Merus VH 35 Variable heavy (vh) domain
QVQLVESGGGLVEPGGSLRLSCAASGFQFSNAWMSWVRQAPGKGLEWVGRIKTTISGGATEFAAPVKGRFTISRDDSKNTLYLQMNSLKTEDTAVYYCTLDLRDYWGQGTLVTVSS

SEQ ID NO: 1127 - protein, 5 aa, Artificial Sequence
  Description of Artificial Sequence: Synthetic peptide
  Merus VH 35 vhCDR1
NAWMS

SEQ ID NO: 1128 - protein, 19 aa, Artificial Sequence
  Description of Artificial Sequence: Synthetic peptide
  Merus VH 35 vhCDR2
RIKTTISGGATEFAAPVKG

SEQ ID NO: 1129 - protein, 5 aa, Artificial Sequence
  Description of Artificial Sequence: Synthetic peptide
  Merus VH 35 vhCDR3
DLRDY

SEQ ID NO: 1130 - protein, 116 aa, Artificial Sequence
  Description of Artificial Sequence: Synthetic polypeptide
  Merus VH 36 Variable heavy (vh) domain
QVQLVESGGGLVEPGGSLRLSCAASGFVFSNAWMSWVRQAPGKGLEWVGRIKTTFSGGATDFAAPVKGRFTISRDDSKNTLYLQMNSLKTEDTAVYYCTLDLRKYWGQGTLVTVSS

SEQ ID NO: 1131 - protein, 5 aa, Artificial Sequence
  Description of Artificial Sequence: Synthetic peptide
  Merus VH 36 vhCDR1
NAWMS

SEQ ID NO: 1132 - protein, 19 aa, Artificial Sequence
  Description of Artificial Sequence: Synthetic peptide
  Merus VH 36 vhCDR2
RIKTTFSGGATDFAAPVKG

SEQ ID NO: 1133 - protein, 5 aa, Artificial Sequence
  Description of Artificial Sequence: Synthetic peptide
  Merus VH 36 vhCDR3
DLRKY

SEQ ID NO: 1134 - protein, 116 aa, Artificial Sequence
  Description of Artificial Sequence: Synthetic polypeptide
  Merus VH 37 Variable heavy (vh) domain
QVQLVESGGGLVEPGGSLRLSCAASGFHFSNAWMSWVRQAPGKGLEWVGRIKTTISGGATDFAAPVKGRFTISRDDSKNTLYLQMNSLKTEDTAVYYCTLDLRAYWGQGTLVTVSS

SEQ ID NO: 1135 - protein, 5 aa, Artificial Sequence
  Description of Artificial Sequence: Synthetic peptide
  Merus VH 37 vhCDR1
NAWMS

SEQ ID NO: 1136 - protein, 19 aa, Artificial Sequence
  Description of Artificial Sequence: Synthetic peptide
  Merus VH 37 vhCDR2
RIKTTISGGATDFAAPVKG

SEQ ID NO: 1137 - protein, 5 aa, Artificial Sequence
  Description of Artificial Sequence: Synthetic peptide
  Merus VH 37 vhCDR3
DLRAY

SEQ ID NO: 1138 - protein, 116 aa, Artificial Sequence
  Description of Artificial Sequence: Synthetic polypeptide
  Merus VH 38 Variable heavy (vh) domain
QVQLVESGGGLVEPGGSLRLSCAASGFKFSNAWMSWVRQAPGKGLEWVGRIKTTISGGKTEFAAPVKGRFTISRDDSKNTLYLQMNSLKTEDTAVYYCTLDLRRYWGQGTLVTVSS

SEQ ID NO: 1139 - protein, 5 aa, Artificial Sequence
  Description of Artificial Sequence: Synthetic peptide
  Merus VH 38 vhCDR1
NAWMS

SEQ ID NO: 1140 - protein, 19 aa, Artificial Sequence
  Description of Artificial Sequence: Synthetic peptide
  Merus VH 38 vhCDR2
RIKTTISGGKTEFAAPVKG

SEQ ID NO: 1141 - protein, 5 aa, Artificial Sequence
  Description of Artificial Sequence: Synthetic peptide
  Merus VH 38 vhCDR3
DLRRY

SEQ ID NO: 1142 - protein, 121 aa, Artificial Sequence
  Description of Artificial Sequence: Synthetic polypeptide
  Merus VH 39 Variable heavy (vh) domain
QVQLVESGGGLVQPGGSLRLSCAVSGFAFRRYAMSWVRQAPGKGLEWVSAISASGDRTHNTDSVKGRFSISRDNSKNTLYLQMNSLRAEDTAVYFCAKGIAKRGKNYFDPWGQGTLVTVSS

SEQ ID NO: 1143 - protein, 5 aa, Artificial Sequence
  Description of Artificial Sequence: Synthetic peptide
  Merus VH 39 vhCDR1
RYAMS

SEQ ID NO: 1144 - protein, 17 aa, Artificial Sequence
  Description of Artificial Sequence: Synthetic peptide
  Merus VH 39 vhCDR2
AISASGDRTHNTDSVKG

SEQ ID NO: 1145 - protein, 12 aa, Artificial Sequence
  Description of Artificial Sequence: Synthetic peptide
  Merus VH 39 vhCDR3
GIAKRGKNYFDP

SEQ ID NO: 1146 - protein, 121 aa, Artificial Sequence
  Description of Artificial Sequence: Synthetic polypeptide
  Merus VH 40 Variable heavy (vh) domain
QVQLVESGGGLVQPGGSLRLSCAVSGFQFRRYAMSWVRQAPGKGLEWVSAISASGDRTHNTDSVKGRFSISRDNSKNTLYLQMNSLRAEDTAVYFCAKGIAKSGKNYFDPWGQGTLVTVSS

SEQ ID NO: 1147 - protein, 5 aa, Artificial Sequence
  Description of Artificial Sequence: Synthetic peptide
  Merus VH 40 vhCDR1
RYAMS

SEQ ID NO: 1148 - protein, 17 aa, Artificial Sequence
  Description of Artificial Sequence: Synthetic peptide
  Merus VH 40 vhCDR2
AISASGDRTHNTDSVKG

SEQ ID NO: 1149 - protein, 12 aa, Artificial Sequence
  Description of Artificial Sequence: Synthetic peptide
  Merus VH 40 vhCDR3
GIAKSGKNYFDP

SEQ ID NO: 1150 - protein, 121 aa, Artificial Sequence
  Description of Artificial Sequence: Synthetic polypeptide
  Merus VH 41 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGIAKSGKNYFDPWGQGTLVTVSS

SEQ ID NO: 1151 - protein, 5 aa, Artificial Sequence
  Description of Artificial Sequence: Synthetic peptide
  Merus VH 41 vhCDR1
RYAMS

SEQ ID NO: 1152 - protein, 17 aa, Artificial Sequence
  Description of Artificial Sequence: Synthetic peptide
  Merus VH 41 vhCDR2
AISASGDRTHNTDSVKG

SEQ ID NO: 1153 - protein, 12 aa, Artificial Sequence
  Description of Artificial Sequence: Synthetic peptide
  Merus VH 41 vhCDR3
GIAKSGKNYFDP

SEQ ID NO: 1154 - protein, 121 aa, Artificial Sequence
  Description of Artificial Sequence: Synthetic polypeptide
  Merus VH 42 Variable heavy (vh) domain
QVQLVESGGGLVQPGGSLRLSCAVSGFKFRRYAMSWVRQAPGKGLEWVSSISASGDRTHNTDSVKGRFSISRDNSKNTLYLQMNSLRAEDTAVYFCAKGLAASGKNYFDPWGQGTLVTVSS

SEQ ID NO: 1155 - protein, 5 aa, Artificial Sequence
  Description of Artificial Sequence: Synthetic peptide
  Merus VH 42 vhCDR1
RYAMS

SEQ ID NO: 1156 - protein, 17 aa, Artificial Sequence
  Description of Artificial Sequence: Synthetic peptide
  Merus VH 42 vhCDR2
SISASGDRTHNTDSVKG

SEQ ID NO: 1157 - protein, 12 aa, Artificial Sequence
  Description of Artificial Sequence: Synthetic peptide
  Merus VH 42 vhCDR3
GLAASGKNYFDP

SEQ ID NO: 1158 - protein, 121 aa, Artificial Sequence
  Description of Artificial Sequence: Synthetic polypeptide
  Merus VH 43 Variable heavy (vh) domain
QVQLVESGGGLVQPGGSLRLSCAVSGFRFRRYAMSWVRQAPGKGLEWVSAISASGDRTHNTDSVKGRFSISRDNSKNTLYLQMNSLRAEDTAVYFCAKGIYASGKHYFDPWGQGTLVTVSS

SEQ ID NO: 1159 - protein, 5 aa, Artificial Sequence
  Description of Artificial Sequence: Synthetic peptide
  Merus VH 43 vhCDR1
RYAMS

SEQ ID NO: 1160 - protein, 17 aa, Artificial Sequence
  Description of Artificial Sequence: Synthetic peptide
  Merus VH 43 vhCDR2
AISASGDRTHNTDSVKG

SEQ ID NO: 1161 - protein, 12 aa, Artificial Sequence
  Description of Artificial Sequence: Synthetic peptide
  Merus VH 43 vhCDR3
GIYASGKHYFDP

SEQ ID NO: 1162 - protein, 121 aa, Artificial Sequence
  Description of Artificial Sequence: Synthetic polypeptide
  Merus VH 44 Variable heavy (vh) domain
QVQLVESGGGLVQPGGSLRLSCAVSGFTFRRYAMSWVRQAPGKGLEWVSAISASGDRTKNTDSVKGRFSISRDNSKNTLYLQMNSLRAEDTAVYFCAKGTAASGRNYFDPWGQGTLVTVSS

SEQ ID NO: 1163 - protein, 5 aa, Artificial Sequence
  Description of Artificial Sequence: Synthetic peptide
  Merus VH 44 vhCDR1
RYAMS

SEQ ID NO: 1164 - protein, 17 aa, Artificial Sequence
  Description of Artificial Sequence: Synthetic peptide
  Merus VH 44 vhCDR2
AISASGDRTKNTDSVKG

SEQ ID NO: 1165 - protein, 12 aa, Artificial Sequence
  Description of Artificial Sequence: Synthetic peptide
  Merus VH 44 vhCDR3
GTAASGRNYFDP

SEQ ID NO: 1166 - protein, 121 aa, Artificial Sequence
  Description of Artificial Sequence: Synthetic polypeptide
  Merus VH 45 Variable heavy (vh) domain
QVQLVESGGGLVQPGGSLRLSCAVSGFAFRRYAMSWVRQAPGKGLEWVSSISASGDRTKNTDSVKGRFSISRDNSKNTLYLQMNSLRAEDTAVYFCAKGIAASGKNYFDPWGQGTLVTVSS

SEQ ID NO: 1167 - protein, 5 aa, Artificial Sequence
  Description of Artificial Sequence: Synthetic peptide
  Merus VH 45 vhCDR1
RYAMS

SEQ ID NO: 1168 - protein, 17 aa, Artificial Sequence
  Description of Artificial Sequence: Synthetic peptide
  Merus VH 45 vhCDR2
SISASGDRTKNTDSVKG

SEQ ID NO: 1169 - protein, 12 aa, Artificial Sequence
  Description of Artificial Sequence: Synthetic peptide
  Merus VH 45 vhCDR3
GIAASGKNYFDP

SEQ ID NO: 1170 - protein, 121 aa, Artificial Sequence
  Description of Artificial Sequence: Synthetic polypeptide
  Merus VH 46 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGIFASGKHYFDPWGQGTLVTVSS

SEQ ID NO: 1171 - protein, 5 aa, Artificial Sequence
  Description of Artificial Sequence: Synthetic peptide
  Merus VH 46 vhCDR1
RYAMS

SEQ ID NO: 1172 - protein, 17 aa, Artificial Sequence
  Description of Artificial Sequence: Synthetic peptide
  Merus VH 46 vhCDR2
AISASGDRTHNTDSVKG

SEQ ID NO: 1173 - protein, 12 aa, Artificial Sequence
  Description of Artificial Sequence: Synthetic peptide
  Merus VH 46 vhCDR3
GIFASGKHYFDP

SEQ ID NO: 1174 - protein, 121 aa, Artificial Sequence
  Description of Artificial Sequence: Synthetic polypeptide
  Merus VH 47 Variable heavy (vh) domain
QVQLVESGGGLVQPGGSLRLSCAVSGFTFGRYAMSWVRQAPGKGLEWVSAISASGDRHHNTDSVKGRFSISRDNSKNTLYLQMNSLRAEDTAVYFCAKGIAKSGKNYFDPWGQGTLVTVSS

SEQ ID NO: 1175 - protein, 5 aa, Artificial Sequence
  Description of Artificial Sequence: Synthetic peptide
  Merus VH 47 vhCDR1
RYAMS

SEQ ID NO: 1176 - protein, 17 aa, Artificial Sequence
  Description of Artificial Sequence: Synthetic peptide
  Merus VH 47 vhCDR2
AISASGDRHHNTDSVKG

SEQ ID NO: 1177 - protein, 12 aa, Artificial Sequence
  Description of Artificial Sequence: Synthetic peptide
  Merus VH 47 vhCDR3
GIAKSGKNYFDP

SEQ ID NO: 1178 - protein, 121 aa, Artificial Sequence
  Description of Artificial Sequence: Synthetic polypeptide
  Merus VH 48 Variable heavy (vh) domain
QVQLVESGGGLVQPGGSLRLSCAVSGFQFRRYAMSWVRQAPGKGLEWVSDISASGDRTHNTDSVKGRFSISRDNSKNTLYLQMNSLRAEDTAVYFCAKGIARSGKNYFDPWGQGTLVTVSS

SEQ ID NO: 1179 - protein, 5 aa, Artificial Sequence
  Description of Artificial Sequence: Synthetic peptide
  Merus VH 48 vhCDR1
RYAMS

SEQ ID NO: 1180 - protein, 17 aa, Artificial Sequence
  Description of Artificial Sequence: Synthetic peptide
  Merus VH 48 vhCDR2
DISASGDRTHNTDSVKG

SEQ ID NO: 1181 - protein, 12 aa, Artificial Sequence
  Description of Artificial Sequence: Synthetic peptide
  Merus VH 48 vhCDR3
GIARSGKNYFDP

SEQ ID NO: 1182 - protein, 121 aa, Artificial Sequence
  Description of Artificial Sequence: Synthetic polypeptide
  Merus VH 49 Variable heavy (vh) domain
QVQLVESGGGLVQPGGSLRLSCAVSGFTFRRYAMSWVRQAPGKGLEWVSAISASGDRTLNTDSVKGRFSISRDNSKNTLYLQMNSLRAEDTAVYFCAKGTAARGKNYFDPWGQGTLVTVSS

SEQ ID NO: 1183 - protein, 5 aa, Artificial Sequence
  Description of Artificial Sequence: Synthetic peptide
  Merus VH 49 vhCDR1
RYAMS

SEQ ID NO: 1184 - protein, 17 aa, Artificial Sequence
  Description of Artificial Sequence: Synthetic peptide
  Merus VH 49 vhCDR2
AISASGDRTLNTDSVKG

SEQ ID NO: 1185 - protein, 12 aa, Artificial Sequence
  Description of Artificial Sequence: Synthetic peptide
  Merus VH 49 vhCDR3
GTAARGKNYFDP

SEQ ID NO: 1186 - protein, 121 aa, Artificial Sequence
  Description of Artificial Sequence: Synthetic polypeptide
  Merus VH 50 Variable heavy (vh) domain
QVQLVESGGGLVQPGGSLRLSCAVSGFAFRRYAMSWVRQAPGKGLEWVSAISAFGDRTHNTDSVKGRFSISRDNSKNTLYLQMNSLRAEDTAVYFCAKGTAASGKNFFDPWGQGTLVTVSS

SEQ ID NO: 1187 - protein, 5 aa, Artificial Sequence
  Description of Artificial Sequence: Synthetic peptide
  Merus VH 50 vhCDR1
RYAMS

SEQ ID NO: 1188 - protein, 17 aa, Artificial Sequence
  Description of Artificial Sequence: Synthetic peptide
  Merus VH 50 vhCDR2
AISAFGDRTHNTDSVKG

SEQ ID NO: 1189 - protein, 12 aa, Artificial Sequence
  Description of Artificial Sequence: Synthetic peptide
  Merus VH 50 vhCDR3
GTAASGKNFFDP

SEQ ID NO: 1190 - protein, 121 aa, Artificial Sequence
  Description of Artificial Sequence: Synthetic polypeptide
  Merus VH 51 Variable heavy (vh) domain
QVQLVESGGGLVQPGGSLRLSCAVSGFTFRRYAMSWVRQAPGKGLEWVSAISASGDRTKNTDSVKGRFSISRDNSKNTLYLQMNSLRAEDTAVYFCAKGTAASGKNFFDPWGQGTLVTVSS

SEQ ID NO: 1191 - protein, 5 aa, Artificial Sequence
  Description of Artificial Sequence: Synthetic peptide
  Merus VH 51 vhCDR1
RYAMS

SEQ ID NO: 1192 - protein, 17 aa, Artificial Sequence
  Description of Artificial Sequence: Synthetic peptide
  Merus VH 51 vhCDR2
AISASGDRTKNTDSVKG

SEQ ID NO: 1193 - protein, 12 aa, Artificial Sequence
  Description of Artificial Sequence: Synthetic peptide
  Merus VH 51 vhCDR3
GTAASGKNFFDP

SEQ ID NO: 1194 - protein, 121 aa, Artificial Sequence
  Description of Artificial Sequence: Synthetic polypeptide
  Merus VH 52 Variable heavy (vh) domain
QVQLVESGGGLVQPGGSLRLSCAVSGFTFSRYAMSWVRQAPGKGLEWVSAISASGDRTKNTDSVKGRFSISRDNSKNTLYLQMNSLRAEDTAVYFCAKGTAAAGKNYFDPWGQGTLVTVSS

SEQ ID NO: 1195 - protein, 5 aa, Artificial Sequence
  Description of Artificial Sequence: Synthetic peptide
  Merus VH 52 vhCDR1
RYAMS

SEQ ID NO: 1196 - protein, 17 aa, Artificial Sequence
  Description of Artificial Sequence: Synthetic peptide
  Merus VH 52 vhCDR2
AISASGDRTKNTDSVKG

SEQ ID NO: 1197 - protein, 12 aa, Artificial Sequence
  Description of Artificial Sequence: Synthetic peptide
  Merus VH 52 vhCDR3
GTAAAGKNYFDP

SEQ ID NO: 1198 - protein, 121 aa, Artificial Sequence
  Description of Artificial Sequence: Synthetic polypeptide
  Merus VH 53 Variable heavy (vh) domain
QVQLVESGGGLVQPGGSLRLSCAVSGFQFRRYAMSWVRQAPGKGLEWVSAISAHGDRTHNTDSVKGRFSISRDNSKNTLYLQMNSLRAEDTAVYFCAKGTAASGKNYFDPWGQGTLVTVSS

SEQ ID NO: 1199 - protein, 5 aa, Artificial Sequence
  Description of Artificial Sequence: Synthetic peptide
  Merus VH 53 vhCDR1
RYAMS

SEQ ID NO: 1200 - protein, 17 aa, Artificial Sequence
  Description of Artificial Sequence: Synthetic peptide
  Merus VH 53 vhCDR2
AISAHGDRTHNTDSVKG

SEQ ID NO: 1201 - protein, 12 aa, Artificial Sequence
  Description of Artificial Sequence: Synthetic peptide
  Merus VH 53 vhCDR3
GTAASGKNYFDP

SEQ ID NO: 1202 - protein, 121 aa, Artificial Sequence
  Description of Artificial Sequence: Synthetic polypeptide
  Merus VH 54 Variable heavy (vh) domain
QVQLVESGGGLVQPGGSLRLSCAVSGFTIRRYAMSWVRQAPGKGLEWVSYISASGDRTHNTDSVKGRFSISRDNSKNTLYLQMNSLRAEDTAVYFCAKGTANSGKNYFDPWGQGTLVTVSS

SEQ ID NO: 1203 - protein, 5 aa, Artificial Sequence
  Description of Artificial Sequence: Synthetic peptide
  Merus VH 54 vhCDR1
RYAMS

SEQ ID NO: 1204 - protein, 17 aa, Artificial Sequence
  Description of Artificial Sequence: Synthetic peptide
  Merus VH 54 vhCDR2
YISASGDRTHNTDSVKG

SEQ ID NO: 1205 - protein, 12 aa, Artificial Sequence
  Description of Artificial Sequence: Synthetic peptide
  Merus VH 54 vhCDR3
GTANSGKNYFDP

SEQ ID NO: 1206 - protein, 121 aa, Artificial Sequence
  Description of Artificial Sequence: Synthetic polypeptide
  Merus VH 55 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGTAARGKNYFDPWGQGTLVTVSS

SEQ ID NO: 1207 - protein, 5 aa, Artificial Sequence
  Description of Artificial Sequence: Synthetic peptide
  Merus VH 55 vhCDR1
RYAMS

SEQ ID NO: 1208 - protein, 17 aa, Artificial Sequence
  Description of Artificial Sequence: Synthetic peptide
  Merus VH 55 vhCDR2
AISASGDRTHNTDSVKG

SEQ ID NO: 1209 - protein, 12 aa, Artificial Sequence
  Description of Artificial Sequence: Synthetic peptide
  Merus VH 55 vhCDR3
GTAARGKNYFDP

SEQ ID NO: 1210 - protein, 121 aa, Artificial Sequence
  Description of Artificial Sequence: Synthetic polypeptide
  Merus VH 56 Variable heavy (vh) domain
QVQLVESGGGLVQPGGSLRLSCAVSGFTFERYAMSWVRQAPGKGLEWVSAISASGDRTQNTDSVKGRFSISRDNSKNTLYLQMNSLRAEDTAVYFCAKGTAASGRNYFDPWGQGTLVTVSS

SEQ ID NO: 1211 - protein, 5 aa, Artificial Sequence
  Description of Artificial Sequence: Synthetic peptide
  Merus VH 56 vhCDR1
RYAMS

SEQ ID NO: 1212 - protein, 17 aa, Artificial Sequence
  Description of Artificial Sequence: Synthetic peptide
  Merus VH 56 vhCDR2
AISASGDRTQNTDSVKG

SEQ ID NO: 1213 - protein, 12 aa, Artificial Sequence
  Description of Artificial Sequence: Synthetic peptide
  Merus VH 56 vhCDR3
GTAASGRNYFDP

SEQ ID NO: 1214 - protein, 121 aa, Artificial Sequence
  Description of Artificial Sequence: Synthetic polypeptide
  Merus VH 57 Variable heavy (vh) domain
QVQLVESGGGLVQPGGSLRLSCAVSGFEFRRYAMSWVRQAPGKGLEWVSAISAGGDRTANTDSVKGRFSISRDNSKNTLYLQMNSLRAEDTAVYFCAKGTAARGKNYFDPWGQGTLVTVSS

SEQ ID NO: 1215 - protein, 5 aa, Artificial Sequence
  Description of Artificial Sequence: Synthetic peptide
  Merus VH 57 vhCDR1
RYAMS

SEQ ID NO: 1216 - protein, 17 aa, Artificial Sequence
  Description of Artificial Sequence: Synthetic peptide
  Merus VH 57 vhCDR2
AISAGGDRTANTDSVKG

SEQ ID NO: 1217 - protein, 12 aa, Artificial Sequence
  Description of Artificial Sequence: Synthetic peptide
  Merus VH 57 vhCDR3
GTAARGKNYFDP

SEQ ID NO: 1218 - protein, 121 aa, Artificial Sequence
  Description of Artificial Sequence: Synthetic polypeptide
  Merus VH 58 Variable heavy (vh) domain
QVQLVESGGGLVQPGGSLRLSCAVSGFAFRRYAMSWVRQAPGKGLEWVSAISASGDRTQNTDSVKGRFSISRDNSKNTLYLQMNSLRAEDTAVYFCAKGTAASGKNYFDPWGQGTLVTVSS

SEQ ID NO: 1219 - protein, 5 aa, Artificial Sequence
  Description of Artificial Sequence: Synthetic peptide
  Merus VH 58 vhCDR1
RYAMS

SEQ ID NO: 1220 - protein, 17 aa, Artificial Sequence
  Description of Artificial Sequence: Synthetic peptide
  Merus VH 58 vhCDR2
AISASGDRTQNTDSVKG

SEQ ID NO: 1221 - protein, 12 aa, Artificial Sequence
  Description of Artificial Sequence: Synthetic peptide
  Merus VH 58 vhCDR3
GTAASGKNYFDP

SEQ ID NO: 1222 - protein, 121 aa, Artificial Sequence
  Description of Artificial Sequence: Synthetic polypeptide
  Merus VH 59 Variable heavy (vh) domain
QVQLVESGGGLVQPGGSLRLSCAVSGFSFRRYAMSWVRQAPGKGLEWVSAISASGDRTLNTDSVKGRFSISRDNSKNTLYLQMNSLRAEDTAVYFCAKGTAARGKNYFDPWGQGTLVTVSS

SEQ ID NO: 1223 - protein, 5 aa, Artificial Sequence
  Description of Artificial Sequence: Synthetic peptide
  Merus VH 59 vhCDR1
RYAMS

SEQ ID NO: 1224 - protein, 17 aa, Artificial Sequence
  Description of Artificial Sequence: Synthetic peptide
  Merus VH 59 vhCDR2
AISASGDRTLNTDSVKG

SEQ ID NO: 1225 - protein, 12 aa, Artificial Sequence
  Description of Artificial Sequence: Synthetic peptide
  Merus VH 59 vhCDR3
GTAARGKNYFDP

SEQ ID NO: 1226 - protein, 121 aa, Artificial Sequence
  Description of Artificial Sequence: Synthetic polypeptide
  Merus VH 60 Variable heavy (vh) domain
QVQLVESGGGLVQPGGSLRLSCAVSGFEFRRYAMSWVRQAPGKGLEWVSAISASGDRTDNTDSVKGRFSISRDNSKNTLYLQMNSLRAEDTAVYFCAKGIARSGKNFFDPWGQGTLVTVSS

SEQ ID NO: 1227 - protein, 5 aa, Artificial Sequence
  Description of Artificial Sequence: Synthetic peptide
  Merus VH 60 vhCDR1
RYAMS

SEQ ID NO: 1228 - protein, 17 aa, Artificial Sequence
  Description of Artificial Sequence: Synthetic peptide
  Merus VH 60 vhCDR2
AISASGDRTDNTDSVKG

SEQ ID NO: 1229 - protein, 12 aa, Artificial Sequence
  Description of Artificial Sequence: Synthetic peptide
  Merus VH 60 vhCDR3
GIARSGKNFFDP

SEQ ID NO: 1230 - protein, 121 aa, Artificial Sequence
  Description of Artificial Sequence: Synthetic polypeptide
  Merus VH 61 Variable heavy (vh) domain
QVQLVESGGGLVQPGGSLRLSCAVSGFNFRRYAMSWVRQAPGKGLEWVSAISASGDRTHNTDSVTGRFSISRDNSKNTLYLQMNSLRAEDTAVYFCAKGLAASGKNYFDPWGQGTLVTVSS

SEQ ID NO: 1231 - protein, 5 aa, Artificial Sequence
  Description of Artificial Sequence: Synthetic peptide
  Merus VH 61 vhCDR1
RYAMS

SEQ ID NO: 1232 - protein, 17 aa, Artificial Sequence
  Description of Artificial Sequence: Synthetic peptide
  Merus VH 61 vhCDR2
AISASGDRTHNTDSVTG

SEQ ID NO: 1233 - protein, 12 aa, Artificial Sequence
  Description of Artificial Sequence: Synthetic peptide
  Merus VH 61 vhCDR3
GLAASGKNYFDP

SEQ ID NO: 1234 - protein, 121 aa, Artificial Sequence
  Description of Artificial Sequence: Synthetic polypeptide
  Merus VH 62 Variable heavy (vh) domain
QVQLVESGGGLVQPGGSLRLSCAVSGFAFRRYAMSWVRQAPGKGLEWVSAISAHGDRTHNTDSVKGRFSISRDNSKNTLYLQMNSLRAEDTAVYFCAKGTAASGKNYFDPWGQGTLVTVSS

SEQ ID NO: 1235 - protein, 5 aa, Artificial Sequence
  Description of Artificial Sequence: Synthetic peptide
  Merus VH 62 vhCDR1
RYAMS

SEQ ID NO: 1236 - protein, 17 aa, Artificial Sequence
  Description of Artificial Sequence: Synthetic peptide
  Merus VH 62 vhCDR2
AISAHGDRTHNTDSVKG

SEQ ID NO: 1237 - protein, 12 aa, Artificial Sequence
  Description of Artificial Sequence: Synthetic peptide
  Merus VH 62 vhCDR3
GTAASGKNYFDP

SEQ ID NO: 1238 - protein, 121 aa, Artificial Sequence
  Description of Artificial Sequence: Synthetic polypeptide
  Merus VH 63 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGLAASGKNFFDPWGQGTLVTVSS

SEQ ID NO: 1239 - protein, 5 aa, Artificial Sequence
  Description of Artificial Sequence: Synthetic peptide
  Merus VH 63 vhCDR1
RYAMS

SEQ ID NO: 1240 - protein, 17 aa, Artificial Sequence
  Description of Artificial Sequence: Synthetic peptide
  Merus VH 63 vhCDR2
AISASGDRTHNTDSVKG

SEQ ID NO: 1241 - protein, 12 aa, Artificial Sequence
  Description of Artificial Sequence: Synthetic peptide
  Merus VH 63 vhCDR3
GLAASGKNFFDP

SEQ ID NO: 1242 - protein, 121 aa, Artificial Sequence
  Description of Artificial Sequence: Synthetic polypeptide
  Merus VH 64 Variable heavy (vh) domain
QVQLVESGGGLVQPGGSLRLSCAVSGFAFRRYAMSWVRQAPGKGLEWVSSISASGDRTHNTDSVKGRFSISRDNSKNTLYLQMNSLRAEDTAVYFCAKGLASSGKNYFDPWGQGTLVTVSS

SEQ ID NO: 1243 - protein, 5 aa, Artificial Sequence
  Description of Artificial Sequence: Synthetic peptide
  Merus VH 64 vhCDR1
RYAMS

SEQ ID NO: 1244 - protein, 17 aa, Artificial Sequence
  Description of Artificial Sequence: Synthetic peptide
  Merus VH 64 vhCDR2
SISASGDRTHNTDSVKG

SEQ ID NO: 1245 - protein, 12 aa, Artificial Sequence
  Description of Artificial Sequence: Synthetic peptide
  Merus VH 64 vhCDR3
GLASSGKNYFDP

SEQ ID NO: 1246 - protein, 121 aa, Artificial Sequence
  Description of Artificial Sequence: Synthetic polypeptide
  Merus VH 65 Variable heavy (vh) domain
QVQLVESGGGLVQPGGSLRLSCAVSGFQFRRYAMSWVRQAPGKGLEWVSSISASGDRTHNTDSVKGRFSISRDNSKNTLYLQMNSLRAEDTAVYFCAKGLAASGKNYFDPWGQGTLVTVSS

SEQ ID NO: 1247 - protein, 5 aa, Artificial Sequence
  Description of Artificial Sequence: Synthetic peptide
  Merus VH 65 vhCDR1
RYAMS

SEQ ID NO: 1248 - protein, 17 aa, Artificial Sequence
  Description of Artificial Sequence: Synthetic peptide
  Merus VH 65 vhCDR2
SISASGDRTHNTDSVKG

SEQ ID NO: 1249 - protein, 12 aa, Artificial Sequence
  Description of Artificial Sequence: Synthetic peptide
  Merus VH 65 vhCDR3
GLAASGKNYFDP

SEQ ID NO: 1250 - protein, 121 aa, Artificial Sequence
  Description of Artificial Sequence: Synthetic polypeptide
  Merus VH 66 Variable heavy (vh) domain
QVQLVESGGGLVQPGGSLRLSCAVSGFQFRRYAMSWVRQAPGKGLEWVSAISASGDRYHNTDSVKGRFSISRDNSKNTLYLQMNSLRAEDTAVYFCAKGTAASGKNYFDPWGQGTLVTVSS

SEQ ID NO: 1251 - protein, 5 aa, Artificial Sequence
  Description of Artificial Sequence: Synthetic peptide
  Merus VH 66 vhCDR1
RYAMS

SEQ ID NO: 1252 - protein, 17 aa, Artificial Sequence
  Description of Artificial Sequence: Synthetic peptide
  Merus VH 66 vhCDR2
AISASGDRYHNTDSVKG

SEQ ID NO: 1253 - protein, 12 aa, Artificial Sequence
  Description of Artificial Sequence: Synthetic peptide
  Merus VH 66 vhCDR3
GTAASGKNYFDP

SEQ ID NO: 1254 - protein, 121 aa, Artificial Sequence
  Description of Artificial Sequence: Synthetic polypeptide
  Merus VH 67 Variable heavy (vh) domain
QVQLVESGGGLVQPGGSLRLSCAVSGFKFRRYAMSWVRQAPGKGLEWVSAISASGDYTHNTDSVKGRFSISRDNSKNTLYLQMNSLRAEDTAVYFCAKGIAKSGKNYFDPWGQGTLVTVSS

SEQ ID NO: 1255 - protein, 5 aa, Artificial Sequence
  Description of Artificial Sequence: Synthetic peptide
  Merus VH 67 vhCDR1
RYAMS

SEQ ID NO: 1256 - protein, 17 aa, Artificial Sequence
  Description of Artificial Sequence: Synthetic peptide
  Merus VH 67 vhCDR2
AISASGDYTHNTDSVKG

SEQ ID NO: 1257 - protein, 12 aa, Artificial Sequence
  Description of Artificial Sequence: Synthetic peptide
  Merus VH 67 vhCDR3
GIAKSGKNYFDP

SEQ ID NO: 1258 - protein, 121 aa, Artificial Sequence
  Description of Artificial Sequence: Synthetic polypeptide
  Merus VH 68 Variable heavy (vh) domain
QVQLVESGGGLVQPGGSLRLSCAVSGFAFRRYAMSWVRQAPGKGLEWVSAISASGDRTRNTDSVKGRFSISRDNSKNTLYLQMNSLRAEDTAVYFCAKGIATSGKNYFDPWGQGTLVTVSS

SEQ ID NO: 1259 - protein, 5 aa, Artificial Sequence
  Description of Artificial Sequence: Synthetic peptide
  Merus VH 68 vhCDR1
RYAMS

SEQ ID NO: 1260 - protein, 17 aa, Artificial Sequence
  Description of Artificial Sequence: Synthetic peptide
  Merus VH 68 vhCDR2
AISASGDRTRNTDSVKG

SEQ ID NO: 1261 - protein, 12 aa, Artificial Sequence
  Description of Artificial Sequence: Synthetic peptide
  Merus VH 68 vhCDR3
GIATSGKNYFDP

SEQ ID NO: 1262 - protein, 121 aa, Artificial Sequence
  Description of Artificial Sequence: Synthetic polypeptide
  Merus VH 69 Variable heavy (vh) domain
QVQLVESGGGLVQPGGSLRLSCAVSGFTFKRYAMSWVRQAPGKGLEWVSAISASGDRSHNTDSVKGRFSISRDNSKNTLYLQMNSLRAEDTAVYFCAKGLAARGKNYFDPWGQGTLVTVSS

SEQ ID NO: 1263 - protein, 5 aa, Artificial Sequence
  Description of Artificial Sequence: Synthetic peptide
  Merus VH 69 vhCDR1
RYAMS

SEQ ID NO: 1264 - protein, 17 aa, Artificial Sequence
  Description of Artificial Sequence: Synthetic peptide
  Merus VH 69 vhCDR2
AISASGDRSHNTDSVKG

SEQ ID NO: 1265 - protein, 12 aa, Artificial Sequence
  Description of Artificial Sequence: Synthetic peptide
  Merus VH 69 vhCDR3
GLAARGKNYFDP

SEQ ID NO: 1266 - protein, 121 aa, Artificial Sequence
  Description of Artificial Sequence: Synthetic polypeptide
  Merus VH 70 Variable heavy (vh) domain
QVQLVESGGGLVQPGGSLRLSCAVSGFNFRRYAMSWVRQAPGKGLEWVSAISASGDRTHNTDSVKGRFSISRDNSKNTLYLQMNSLRAEDTAVYFCAKGTAARGKNYFDPWGQGTLVTVSS

SEQ ID NO: 1267 - protein, 5 aa, Artificial Sequence
  Description of Artificial Sequence: Synthetic peptide
  Merus VH 70 vhCDR1
RYAMS

SEQ ID NO: 1268 - protein, 17 aa, Artificial Sequence
  Description of Artificial Sequence: Synthetic peptide
  Merus VH 70 vhCDR2
AISASGDRTHNTDSVKG

SEQ ID NO: 1269 - protein, 12 aa, Artificial Sequence
  Description of Artificial Sequence: Synthetic peptide
  Merus VH 70 vhCDR3
GTAARGKNYFDP

SEQ ID NO: 1270 - protein, 121 aa, Artificial Sequence
  Description of Artificial Sequence: Synthetic polypeptide
  Merus VH 71 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGIAASGKNFFDPWGQGTLVTVSS

SEQ ID NO: 1271 - protein, 5 aa, Artificial Sequence
  Description of Artificial Sequence: Synthetic peptide
  Merus VH 71 vhCDR1
RYAMS

SEQ ID NO: 1272 - protein, 17 aa, Artificial Sequence
  Description of Artificial Sequence: Synthetic peptide
  Merus VH 71 vhCDR2
AISASGDRTHNTDSVKG

SEQ ID NO: 1273 - protein, 12 aa, Artificial Sequence
  Description of Artificial Sequence: Synthetic peptide
  Merus VH 71 vhCDR3
GIAASGKNFFDP

SEQ ID NO: 1274 - protein, 121 aa, Artificial Sequence
  Description of Artificial Sequence: Synthetic polypeptide
  Merus VH 72 Variable heavy (vh) domain
QVQLVESGGGLVQPGGSLRLSCAVSGFTFRRYAMSWVRQAPGKGLEWVSAISASGDRTHNTDSVKGRFSISRDNSKNTLYLQMNSLRAEDTAVYFCAKGIAARGKNYFDPWGQGTLVTVSS

SEQ ID NO: 1275 - protein, 5 aa, Artificial Sequence
  Description of Artificial Sequence: Synthetic peptide
  Merus VH 72 vhCDR1
RYAMS

SEQ ID NO: 1276 - protein, 17 aa, Artificial Sequence
  Description of Artificial Sequence: Synthetic peptide
  Merus VH 72 vhCDR2
AISASGDRTHNTDSVKG

SEQ ID NO: 1277 - protein, 12 aa, Artificial Sequence
  Description of Artificial Sequence: Synthetic peptide
  Merus VH 72 vhCDR3
GIAARGKNYFDP

SEQ ID NO: 1278 - protein, 121 aa, Artificial Sequence
  Description of Artificial Sequence: Synthetic polypeptide
  Merus VH 73 Variable heavy (vh) domain
QVQLVESGGGLVQPGGSLRLSCAVSGFRFRRYAMSWVRQAPGKGLEWVSAISASGDRTHNTDSVKGRFSISRDNSKNTLYLQMNSLRAEDTAVYFCAKGIAARGKNFFDPWGQGTLVTVSS

SEQ ID NO: 1279 - protein, 5 aa, Artificial Sequence
  Description of Artificial Sequence: Synthetic peptide
  Merus VH 73 vhCDR1
RYAMS

SEQ ID NO: 1280 - protein, 17 aa, Artificial Sequence
  Description of Artificial Sequence: Synthetic peptide
  Merus VH 73 vhCDR2
AISASGDRTHNTDSVKG

SEQ ID NO: 1281 - protein, 12 aa, Artificial Sequence
  Description of Artificial Sequence: Synthetic peptide
  Merus VH 73 vhCDR3
GIAARGKNFFDP

SEQ ID NO: 1282 - protein, 127 aa, Artificial Sequence
  Description of Artificial Sequence: Synthetic polypeptide
  Merus VH 74 Variable heavy (vh) domain
EVQLVETGAEVKKPGASVKVSCKASDYIFTKYDINWVRQAPGQGLEWMGWMSANTGNTGYAQKFQGRVTMTRDTSINTAYMELSSLTSGDTAVYFCARSSLFKTETAPYYHFALDVWGQGTTVTVSS

SEQ ID NO: 1283 - protein, 5 aa, Artificial Sequence
  Description of Artificial Sequence: Synthetic peptide
  Merus VH 74 vhCDR1
KYDIN

SEQ ID NO: 1284 - protein, 17 aa, Artificial Sequence
  Description of Artificial Sequence: Synthetic peptide
  Merus VH 74 vhCDR2
WMSANTGNTGYAQKFQG

SEQ ID NO: 1285 - protein, 18 aa, Artificial Sequence
  Description of Artificial Sequence: Synthetic peptide
  Merus VH 74 vhCDR3
SSLFKTETAPYYHFALDV

SEQ ID NO: 1286 - protein, 116 aa, Artificial Sequence
  Description of Artificial Sequence: Synthetic polypeptide
  Merus VH 75 Variable heavy (vh) domain
EVQLVESGGDLVKPGGSLRLSCAASGFTFSNAWMSWVRQAPGKGLEWVGRVKTTVSGGTTDYAAAVKGRFTISRDDSKNTLYLQMNSLKTEDTAIYYCTIDLRDYWGQGTLVTVSS

SEQ ID NO: 1287 - protein, 5 aa, Artificial Sequence
  Description of Artificial Sequence: Synthetic peptide
  Merus VH 75 vhCDR1
NAWMS

SEQ ID NO: 1288 - protein, 19 aa, Artificial Sequence
  Description of Artificial Sequence: Synthetic peptide
  Merus VH 75 vhCDR2
RVKTTVSGGTTDYAAAVKG

SEQ ID NO: 1289 - protein, 5 aa, Artificial Sequence
  Description of Artificial Sequence: Synthetic peptide
  Merus VH 75 vhCDR3
DLRDY

SEQ ID NO: 1290 - protein, 121 aa, Artificial Sequence
  Description of Artificial Sequence: Synthetic polypeptide
  Merus VH 76 Variable heavy (vh) domain
EVQLVESGGGLVQPGGSLRLSCAASGFTFSRYAMSWVRQAPGKGLEWVSSINTSGGNTFYADSVKGRFTISRDNSKNTLYLQMNSLRAEDTAIYYCAKGIAATGKNYFDPWGQGTLVTVSS

SEQ ID NO: 1291 - protein, 5 aa, Artificial Sequence
  Description of Artificial Sequence: Synthetic peptide
  Merus VH 76 vhCDR1
RYAMS

SEQ ID NO: 1292 - protein, 17 aa, Artificial Sequence
  Description of Artificial Sequence: Synthetic peptide
  Merus VH 76 vhCDR2
SINTSGGNTFYADSVKG

SEQ ID NO: 1293 - protein, 12 aa, Artificial Sequence
  Description of Artificial Sequence: Synthetic peptide
  Merus VH 76 vhCDR3
GIAATGKNYFDP

SEQ ID NO: 1294 - protein, 121 aa, Artificial Sequence
  Description of Artificial Sequence: Synthetic polypeptide
  Merus VH 77 Variable heavy (vh) domain
QVQLVESGGGLVQPGGSLRLSCAASGFTFSRYAMSWVRQAPGKGLEWVSSINTSGGNTFYADSVKGRFTISRDNSKNTLYLQMNSLRAEDTAVYYCVKGIAAAGKNWFGPWGQGTLVTVSS

SEQ ID NO: 1295 - protein, 5 aa, Artificial Sequence
  Description of Artificial Sequence: Synthetic peptide
  Merus VH 77 vhCDR1
RYAMS

SEQ ID NO: 1296 - protein, 17 aa, Artificial Sequence
  Description of Artificial Sequence: Synthetic peptide
  Merus VH 77 vhCDR2
SINTSGGNTFYADSVKG

SEQ ID NO: 1297 - protein, 12 aa, Artificial Sequence
  Description of Artificial Sequence: Synthetic peptide
  Merus VH 77 vhCDR3
GIAAAGKNWFGP

SEQ ID NO: 1298 - protein, 121 aa, Artificial Sequence
  Description of Artificial Sequence: Synthetic polypeptide
  Merus VH 78 Variable heavy (vh) domain
QVQLVESGGGLVQPGGSLSLSCAASGFTFSRYAMSWVRQAPGKGLEWVSSINTSGGNTYYADSVKGRFTISRDNSKNTLYLQMNSLRAEDTAVYYCAKGIAASGKNYFDPWGQGTLVTVSS

SEQ ID NO: 1299 - protein, 5 aa, Artificial Sequence
  Description of Artificial Sequence: Synthetic peptide
  Merus VH 78 vhCDR1
RYAMS

SEQ ID NO: 1300 - protein, 17 aa, Artificial Sequence
  Description of Artificial Sequence: Synthetic peptide
  Merus VH 78 vhCDR2
SINTSGGNTYYADSVKG

SEQ ID NO: 1301 - protein, 12 aa, Artificial Sequence
  Description of Artificial Sequence: Synthetic peptide
  Merus VH 78 vhCDR3
GIAASGKNYFDP

SEQ ID NO: 1302 - protein, 125 aa, Artificial Sequence
  Description of Artificial Sequence: Synthetic polypeptide
  Merus VH 79 Variable heavy (vh) domain
EVQLVESGGGVVQPGRSLRLSCAASGFTFSNYGMHWVRQAPGKGLEWVAVISYDGSTKYSADSLKGRFTISRDNSKNTLYLQMNSLRADDTAVYYCAKEGWSFDSSGYRSWFDSWGQGTLVTVSS

SEQ ID NO: 1303 - protein, 5 aa, Artificial Sequence
  Description of Artificial Sequence: Synthetic peptide
  Merus VH 79 vhCDR1
NYGMH

SEQ ID NO: 1304 - protein, 17 aa, Artificial Sequence
  Description of Artificial Sequence: Synthetic peptide
  Merus VH 79 vhCDR2
VISYDGSTKYSADSLKG

SEQ ID NO: 1305 - protein, 16 aa, Artificial Sequence
  Description of Artificial Sequence: Synthetic peptide
  Merus VH 79 vhCDR3
EGWSFDSSGYRSWFDS

SEQ ID NO: 1306 - protein, 121 aa, Artificial Sequence
  Description of Artificial Sequence: Synthetic polypeptide
  Merus VH 80 Variable heavy (vh) domain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARSFRGGYTAFDVWGQGTLVTVSS

SEQ ID NO: 1307 - protein, 7 aa, Artificial Sequence
  Description of Artificial Sequence: Synthetic peptide
  Merus VH 80 vhCDR1
SSSYYWG

SEQ ID NO: 1308 - protein, 16 aa, Artificial Sequence
  Description of Artificial Sequence: Synthetic peptide
  Merus VH 80 vhCDR2
SIYYSGSTYYNPSLKS

SEQ ID NO: 1309 - protein, 11 aa, Artificial Sequence
  Description of Artificial Sequence: Synthetic peptide
  Merus VH 80 vhCDR3
SFRGGYTAFDV

SEQ ID NO: 1310 - protein, 125 aa, Artificial Sequence; identical to SEQ ID NO: 1302
  Description of Artificial Sequence: Synthetic polypeptide
  Merus VH 81 Variable heavy (vh) domain

SEQ ID NO: 1311 - protein, 5 aa, Artificial Sequence
  Description of Artificial Sequence: Synthetic peptide
  Merus VH 81 vhCDR1
NYGMH

SEQ ID NO: 1312 - protein, 17 aa, Artificial Sequence
  Description of Artificial Sequence: Synthetic peptide
  Merus VH 81 vhCDR2
VISYDGSTKYSADSLKG

SEQ ID NO: 1313 - protein, 16 aa, Artificial Sequence
  Description of Artificial Sequence: Synthetic peptide
  Merus VH 81 vhCDR3
EGWSFDSSGYRSWFDS

SEQ ID NO: 1314 - protein, 95 aa, Artificial Sequence
  Description of Artificial Sequence: Synthetic polypeptide
  IGKV1-39 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 1315 - protein, 107 aa, Artificial Sequence
  Description of Artificial Sequence: Synthetic polypeptide
  IGKV1-39/jk1 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 1316 - protein, 11 aa, Artificial Sequence
  Description of Artificial Sequence: Synthetic peptide
  IGKV1-39/jk1 vlCDR1
RASQSISSYLN

SEQ ID NO: 1317 - protein, 7 aa, Artificial Sequence
  Description of Artificial Sequence: Synthetic peptide
  IGKV1-39/jk1 vlCDR2
AASSLQS

SEQ ID NO: 1318 - protein, 9 aa, Artificial Sequence
  Description of Artificial Sequence: Synthetic peptide
  IGKV1-39/jk1 vlCDR3
QQSYSTPPT

SEQ ID NO: 1319 - protein, 108 aa, Artificial Sequence
  Description of Artificial Sequence: Synthetic polypeptide
  IGKV1-39/jk5 Variable light (vl) domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 1320 - protein, 11 aa, Artificial Sequence
  Description of Artificial Sequence: Synthetic peptide
  IGKV1-39/jk5 vlCDR1
RASQSISSYLN

SEQ ID NO: 1321 - protein, 7 aa, Artificial Sequence
  Description of Artificial Sequence: Synthetic peptide
  IGKV1-39/jk5 vlCDR2
AASSLQS

SEQ ID NO: 1322 - protein, 10 aa, Artificial Sequence
  Description of Artificial Sequence: Synthetic peptide
  IGKV1-39/jk5 vlCDR3
QQSYSTPPIT

SEQ ID NO: 1323 - protein, 121 aa, Artificial Sequence; identical to SEQ ID NO: 525
  Description of Artificial Sequence: Synthetic polypeptide
  TBRII-A[TGF-beta-RII]_H1

SEQ ID NO: 1324 - protein, 121 aa, Artificial Sequence
  Description of Artificial Sequence: Synthetic polypeptide
  TBRII-A[TGF-beta-RII]_H1.1
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSS

SEQ ID NO: 1325 - protein, 121 aa, Artificial Sequence
  Description of Artificial Sequence: Synthetic polypeptide
  TBRII-A[TGF-beta-RII]_H1.2
QVQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1326 - protein, 121 aa, Artificial Sequence
  Description of Artificial Sequence: Synthetic polypeptide
  TBRII-A[TGF-beta-RII]_H1.3
QVQLQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1327 - protein, 121 aa, Artificial Sequence
  Description of Artificial Sequence: Synthetic polypeptide
  TBRII-A[TGF-beta-RII]_H1.4
QLQLQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1328 - protein, 121 aa, Artificial Sequence
  Description of Artificial Sequence: Synthetic polypeptide
  TBRII-A[TGF-beta-RII]_H1.5
QLQVQESGSGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1329 - protein, 121 aa, Artificial Sequence
  Description of Artificial Sequence: Synthetic polypeptide
  TBRII-A[TGF-beta-RII]_H1.6
QLQVQESGPGLVKPSQTLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1330 - protein, 121 aa, Artificial Sequence
  Description of Artificial Sequence: Synthetic polypeptide
  TBRII-A[TGF-beta-RII]_H1.7
QLQVQESGPGLVKPSETLSLTCAVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1331 - protein, 121 aa, Artificial Sequence
  Description of Artificial Sequence: Synthetic polypeptide
  TBRII-A[TGF-beta-RII]_H1.8
QLQVQESGPGLVKPSETLSLTCTVSGYSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1332 - protein, 121 aa, Artificial Sequence
  Description of Artificial Sequence: Synthetic polypeptide
  TBRII-A[TGF-beta-RII]_H1.9
QLQVQESGPGLVKPSETLSLTCTVSGGSFSNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1333 - protein, 121 aa, Artificial Sequence
  Description of Artificial Sequence: Synthetic polypeptide
  TBRII-A[TGF-beta-RII]_H1.10
QLQVQESGPGLVKPSETLSLTCTVSGGSVSNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1334 - protein, 121 aa, Artificial Sequence
  Description of Artificial Sequence: Synthetic polypeptide
  TBRII-A[TGF-beta-RII]_H1.11
QLQVQESGPGLVKPSETLSLTCTVSGGSISDSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1335 - protein, 121 aa, Artificial Sequence
  Description of Artificial Sequence: Synthetic polypeptide
  TBRII-A[TGF-beta-RII]_H1.12
QLQVQESGPGLVKPSETLSLTCTVSGGSISESYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1336 - protein, 121 aa, Artificial Sequence
  Description of Artificial Sequence: Synthetic polypeptide
  TBRII-A[TGF-beta-RII]_H1.13
QLQVQESGPGLVKPSETLSLTCTVSGGSISGSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1337 - protein, 121 aa, Artificial Sequence
  Description of Artificial Sequence: Synthetic polypeptide
  TBRII-A[TGF-beta-RII]_H1.14
QLQVQESGPGLVKPSETLSLTCTVSGGSISSSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1338 - protein, 121 aa, Artificial Sequence
  Description of Artificial Sequence: Synthetic polypeptide
  TBRII-A[TGF-beta-RII]_H1.15
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1339 - protein, 121 aa, Artificial Sequence
  Description of Artificial Sequence: Synthetic polypeptide
  TBRII-A[TGF-beta-RII]_H1.16
QLQVQESGPGLVKPSETLSLTCTVSGGSISQSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1340 - protein, 121 aa, Artificial Sequence
  Description of Artificial Sequence: Synthetic polypeptide
  TBRII-A[TGF-beta-RII]_H1.17
QLQVQESGPGLVKPSETLSLTCTVSGGSISRSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1341 - protein, 121 aa, Artificial Sequence
  Description of Artificial Sequence: Synthetic polypeptide
  TBRII-A[TGF-beta-RII]_H1.18
QLQVQESGPGLVKPSETLSLTCTVSGGSISNAYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1342 - protein, 121 aa, Artificial Sequence
  Description of Artificial Sequence: Synthetic polypeptide
  TBRII-A[TGF-beta-RII]_H1.19
QLQVQESGPGLVKPSETLSLTCTVSGGSISNGYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1343 - protein, 121 aa, Artificial Sequence
  Description of Artificial Sequence: Synthetic polypeptide
  TBRII-A[TGF-beta-RII]_H1.20
QLQVQESGPGLVKPSETLSLTCTVSGGSISNTYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1344 - protein, 121 aa, Artificial Sequence
  Description of Artificial Sequence: Synthetic polypeptide
  TBRII-A[TGF-beta-RII]_H1.21
QLQVQESGPGLVKPSETLSLTCTVSGGSISNSAFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1345 - protein, 121 aa, Artificial Sequence
  Description of Artificial Sequence: Synthetic polypeptide
  TBRII-A[TGF-beta-RII]_H1.22
QLQVQESGPGLVKPSETLSLTCTVSGGSISNSDFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1346 - protein, 121 aa, Artificial Sequence
  Description of Artificial Sequence: Synthetic polypeptide
  TBRII-A[TGF-beta-RII]_H1.23
QLQVQESGPGLVKPSETLSLTCTVSGGSISNSGFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1347 - protein, 121 aa, Artificial Sequence
  Description of Artificial Sequence: Synthetic polypeptide
  TBRII-A[TGF-beta-RII]_H1.24
QLQVQESGPGLVKPSETLSLTCTVSGGSISNSHFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1348 - protein, 121 aa, Artificial Sequence
  Description of Artificial Sequence: Synthetic polypeptide
  TBRII-A[TGF-beta-RII]_H1.25
QLQVQESGPGLVKPSETLSLTCTVSGGSISNSYHSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1349 - protein, 121 aa, Artificial Sequence
  Description of Artificial Sequence: Synthetic polypeptide
  TBRII-A[TGF-beta-RII]_H1.26
QLQVQESGPGLVKPSETLSLTCTVSGGSISNSYSSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1350 - protein, 121 aa, Artificial Sequence
  Description of Artificial Sequence: Synthetic polypeptide
  TBRII-A[TGF-beta-RII]_H1.27
QLQVQESGPGLVKPSETLSLTCTVSGGSISNSYYSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1351 - protein, 121 aa, Artificial Sequence
  Description of Artificial Sequence: Synthetic polypeptide
  TBRII-A[TGF-beta-RII]_H1.28
QLQVQESGPGLVKPSETLSLTCTVSGGSISNSYFAWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1352 - protein, 121 aa, Artificial Sequence
  Description of Artificial Sequence: Synthetic polypeptide
  TBRII-A[TGF-beta-RII]_H1.29
QLQVQESGPGLVKPSETLSLTCTVSGGSISNSYFTWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1353 - protein, 121 aa, Artificial Sequence
  Description of Artificial Sequence: Synthetic polypeptide
  TBRII-A[TGF-beta-RII]_H1.30
QLQVQESGPGLVKPSETLSLTCTVSGGSISNSYFYWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1354 - protein, 121 aa, Artificial Sequence
  Description of Artificial Sequence: Synthetic polypeptide
  TBRII-A[TGF-beta-RII]_H1.31
QLQVQESGPGLVKPSETLSLTCTVSGGSISNSYFSIGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1355 - protein, 121 aa, Artificial Sequence
  Description of Artificial Sequence: Synthetic polypeptide
  TBRII-A[TGF-beta-RII]_H1.32
QLQVQESGPGLVKPSETLSLTCTVSGGSISNSYFSMGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1356 - protein, 121 aa, Artificial Sequence
  Description of Artificial Sequence: Synthetic polypeptide
  TBRII-A[TGF-beta-RII]_H1.33
QLQVQESGPGLVKPSETLSLTCTVSGGSISNSYFSWAWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1357 - protein, 121 aa, Artificial Sequence
  Description of Artificial Sequence: Synthetic polypeptide
  TBRII-A[TGF-beta-RII]_H1.34
QLQVQESGPGLVKPSETLSLTCTVSGGSISNSYFSWHWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1358 - protein, 121 aa, Artificial Sequence
  Description of Artificial Sequence: Synthetic polypeptide
  TBRII-A[TGF-beta-RII]_H1.35
QLQVQESGPGLVKPSETLSLTCTVSGGSISNSYFSWNWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1359 - protein, 121 aa, Artificial Sequence
  Description of Artificial Sequence: Synthetic polypeptide
  TBRII-A[TGF-beta-RII]_H1.36
QLQVQESGPGLVKPSETLSLTCTVSGGSISNSYFSWSWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1360 - protein, 121 aa, Artificial Sequence
  Description of Artificial Sequence: Synthetic polypeptide
  TBRII-A[TGF-beta-RII]_H1.37
QLQVQESGPGLVKPSETLSLTCTVSGGSISNSYFSWGWVRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1361 - protein, 121 aa, Artificial Sequence
  Description of Artificial Sequence: Synthetic polypeptide
  TBRII-A[TGF-beta-RII]_H1.38
QLQVQESGPGLVKPSETLSLTCTVSGGSISNSYFSWGWIRQAPGKGLEWIGSFYYGEKTYYNPSLKSRATISIDTSKSQFSLKLSSVTAADTAVYYCPRGPTMIRGVIDSWGQGTLVTVSS

SEQ ID NO: 1362 - protein, 121 aa, Artificial Sequence
  Description of Artificial Sequence: Synthetic polypeptide
  TBRII-A[TGF-beta-RII]_H1.39
QLQVQESGPGLVKPSETLSLTCTVSGGSISNSYFSWGWIRQHPGKGLEWIGSFYYGEKTYYNPSLKSRATISIDTSKSQFSLKLSSVTAADTAVYYCPRGPTMIRGVIDSWGQGTLVTVSS

SEQ ID NO: 1363 - protein, 121 aa, Artificial Sequence
  Description of Artificial Sequence: Synthetic polypeptide
  TBRII-A[TGF-beta-RII]_H1.40
QLQVQESGPGLVKPSETLSLTCTVSGGSISNSYFSWGWIRQPPGKGLEWVGSFYYGEKTYYNPSLKSRATISIDTSKSQFSLKLSSVTAADTAVYYCPRGPTMIRGVIDSWGQGTLVTVSS

SEQ ID NO: 1364 - protein, 121 aa, Artificial Sequence
  Description of Artificial Sequence: Synthetic polypeptide
  TBRII-A[TGF-beta-RII]_H1.41
QLQVQESGPGLVKPSETLSLTCTVSGGSISNSYFSWGWIRQPPGKGLEWIGEFYYGEKTYYNPSLKSRATISIDTSKSQFSLKLSSVTAADTAVYYCPRGPTMIRGVIDSWGQGTLVTVSS

SEQ ID NO: 1365 - protein, 121 aa, Artificial Sequence
  Description of Artificial Sequence: Synthetic polypeptide
  TBRII-A[TGF-beta-RII]_H1.42
QLQVQESGPGLVKPSETLSLTCTVSGGSISNSYFSWGWIRQPPGKGLEWIGNFYYGEKTYYNPSLKSRATISIDTSKSQFSLKLSSVTAADTAVYYCPRGPTMIRGVIDSWGQGTLVTVSS

SEQ ID NO: 1366 - protein, 121 aa, Artificial Sequence
  Description of Artificial Sequence: Synthetic polypeptide
  TBRII-A[TGF-beta-RII]_H1.43
QLQVQESGPGLVKPSETLSLTCTVSGGSISNSYFSWGWIRQPPGKGLEWIGTFYYGEKTYYNPSLKSRATISIDTSKSQFSLKLSSVTAADTAVYYCPRGPTMIRGVIDSWGQGTLVTVSS

SEQ ID NO: 1367 - protein, 121 aa, Artificial Sequence
  Description of Artificial Sequence: Synthetic polypeptide
  TBRII-A[TGF-beta-RII]_H1.44
QLQVQESGPGLVKPSETLSLTCTVSGGSISNSYFSWGWIRQPPGKGLEWIGVFYYGEKTYYNPSLKSRATISIDTSKSQFSLKLSSVTAADTAVYYCPRGPTMIRGVIDSWGQGTLVTVSS

SEQ ID NO: 1368 - protein, 121 aa, Artificial Sequence
  Description of Artificial Sequence: Synthetic polypeptide
  TBRII-A[TGF-beta-RII]_H1.45
QLQVQESGPGLVKPSETLSLTCTVSGGSISNSYFSWGWIRQPPGKGLEWIGYFYYGEKTYYNPSLKSRATISIDTSKSQFSLKLSSVTAADTAVYYCPRGPTMIRGVIDSWGQGTLVTVSS

SEQ ID NO: 1369 - protein, 121 aa, Artificial Sequence
  Description of Artificial Sequence: Synthetic polypeptide
  TBRII-A[TGF-beta-RII]_H1.46
QLQVQESGPGLVKPSETLSLTCTVSGGSISNSYFSWGWIRQPPGKGLEWIGSIYYGEKTYYNPSLKSRATISIDTSKSQFSLKLSSVTAADTAVYYCPRGPTMIRGVIDSWGQGTLVTVSS

SEQ ID NO: 1370 - protein, 121 aa, Artificial Sequence
  Description of Artificial Sequence: Synthetic polypeptide
  TBRII-A[TGF-beta-RII]_H1.47
QLQVQESGPGLVKPSETLSLTCTVSGGSISNSYFSWGWIRQPPGKGLEWIGSVYYGEKTYYNPSLKSRATISIDTSKSQFSLKLSSVTAADTAVYYCPRGPTMIRGVIDSWGQGTLVTVSS

SEQ ID NO: 1371 - protein, 121 aa, Artificial Sequence
  Description of Artificial Sequence: Synthetic polypeptide
  TBRII-A[TGF-beta-RII]_H1.48
QLQVQESGPGLVKPSETLSLTCTVSGGSISNSYFSWGWIRQPPGKGLEWIGSFDYGEKTYYNPSLKSRATISIDTSKSQFSLKLSSVTAADTAVYYCPRGPTMIRGVIDSWGQGTLVTVSS

SEQ ID NO: 1372 - protein, 121 aa, Artificial Sequence
  Description of Artificial Sequence: Synthetic polypeptide
  TBRII-A[TGF-beta-RII]_H1.49
QLQVQESGPGLVKPSETLSLTCTVSGGSISNSYFSWGWIRQPPGKGLEWIGSFHYGEKTYYNPSLKSRATISIDTSKSQFSLKLSSVTAADTAVYYCPRGPTMIRGVIDSWGQGTLVTVSS

SEQ ID NO: 1373 - protein, 121 aa, Artificial Sequence
  Description of Artificial Sequence: Synthetic polypeptide
  TBRII-A[TGF-beta-RII]_H1.50
QLQVQESGPGLVKPSETLSLTCTVSGGSISNSYFSWGWIRQPPGKGLEWIGSFKYGEKTYYNPSLKSRATISIDTSKSQFSLKLSSVTAADTAVYYCPRGPTMIRGVIDSWGQGTLVTVSS

SEQ ID NO: 1374 - protein, 121 aa, Artificial Sequence
  Description of Artificial Sequence: Synthetic polypeptide
  TBRII-A[TGF-beta-RII]_H1.51
QLQVQESGPGLVKPSETLSLTCTVSGGSISNSYFSWGWIRQPPGKGLEWIGSFNYGEKTYYNPSLKSRATISIDTSKSQFSLKLSSVTAADTAVYYCPRGPTMIRGVIDSWGQGTLVTVSS

SEQ ID NO: 1375 - protein, 121 aa, Artificial Sequence
  Description of Artificial Sequence: Synthetic polypeptide
  TBRII-A[TGF-beta-RII]_H1.52
QLQVQESGPGLVKPSETLSLTCTVSGGSISNSYFSWGWIRQPPGKGLEWIGSFSYGEKTYYNPSLKSRATISIDTSKSQFSLKLSSVTAADTAVYYCPRGPTMIRGVIDSWGQGTLVTVSS

SEQ ID NO: 1376 - protein, 121 aa, Artificial Sequence
  Description of Artificial Sequence: Synthetic polypeptide
  TBRII-A[TGF-beta-RII]_H1.53
QLQVQESGPGLVKPSETLSLTCTVSGGSISNSYFSWGWIRQPPGKGLEWIGSFYHGEKTYYNPSLKSRATISIDTSKSQFSLKLSSVTAADTAVYYCPRGPTMIRGVIDSWGQGTLVTVSS

SEQ ID NO: 1377 - protein, 121 aa, Artificial Sequence
  Description of Artificial Sequence: Synthetic polypeptide
  TBRII-A[TGF-beta-RII]_H1.54
QLQVQESGPGLVKPSETLSLTCTVSGGSISNSYFSWGWIRQPPGKGLEWIGSFYSGEKTYYNPSLKSRATISIDTSKSQFSLKLSSVTAADTAVYYCPRGPTMIRGVIDSWGQGTLVTVSS

SEQ ID NO: 1378 - protein, 121 aa, Artificial Sequence
  Description of Artificial Sequence: Synthetic polypeptide
  TBRII-A[TGF-beta-RII]_H1.55
QLQVQESGPGLVKPSETLSLTCTVSGGSISNSYFSWGWIRQPPGKGLEWIGSFYYSEKTYYNPSLKSRATISIDTSKSQFSLKLSSVTAADTAVYYCPRGPTMIRGVIDSWGQGTLVTVSS

SEQ ID NO: 1379 - protein, 121 aa, Artificial Sequence
  Description of Artificial Sequence: Synthetic polypeptide
  TBRII-A[TGF-beta-RII]_H1.56
QLQVQESGPGLVKPSETLSLTCTVSGGSISNSYFSWGWIRQPPGKGLEWIGSFYYGGKTYYNPSLKSRATISIDTSKSQFSLKLSSVTAADTAVYYCPRGPTMIRGVIDSWGQGTLVTVSS

SEQ ID NO: 1380 - protein, 121 aa, Artificial Sequence
  Description of Artificial Sequence: Synthetic polypeptide
  TBRII-A[TGF-beta-RII]_H1.57
QLQVQESGPGLVKPSETLSLTCTVSGGSISNSYFSWGWIRQPPGKGLEWIGSFYYGSKTYYNPSLKSRATISIDTSKSQFSLKLSSVTAADTAVYYCPRGPTMIRGVIDSWGQGTLVTVSS

SEQ ID NO: 1381 - protein, 121 aa, Artificial Sequence
  Description of Artificial Sequence: Synthetic polypeptide
  TBRII-A[TGF-beta-RII]_H1.58
QLQVQESGPGLVKPSETLSLTCTVSGGSISNSYFSWGWIRQPPGKGLEWIGSFYYGEDTYYNPSLKSRATISIDTSKSQFSLKLSSVTAADTAVYYCPRGPTMIRGVIDSWGQGTLVTVSS

SEQ ID NO: 1382 - protein, 121 aa, Artificial Sequence
  Description of Artificial Sequence: Synthetic polypeptide
  TBRII-A[TGF-beta-RII]_H1.59
QLQVQESGPGLVKPSETLSLTCTVSGGSISNSYFSWGWIRQPPGKGLEWIGSFYYGENTYYNPSLKSRATISIDTSKSQFSLKLSSVTAADTAVYYCPRGPTMIRGVIDSWGQGTLVTVSS

SEQ ID NO: 1383 - protein, 121 aa, Artificial Sequence
  Description of Artificial Sequence: Synthetic polypeptide
  TBRII-A[TGF-beta-RII]_H1.60
QLQVQESGPGLVKPSETLSLTCTVSGGSISNSYFSWGWIRQPPGKGLEWIGSFYYGESTYYNPSLKSRATISIDTSKSQFSLKLSSVTAADTAVYYCPRGPTMIRGVIDSWGQGTLVTVSS

SEQ ID NO: 1384 - protein, 121 aa, Artificial Sequence
  Description of Artificial Sequence: Synthetic polypeptide
  TBRII-A[TGF-beta-RII]_H1.61
QLQVQESGPGLVKPSETLSLTCTVSGGSISNSYFSWGWIRQPPGKGLEWIGSFYYGEKIYYNPSLKSRATISIDTSKSQFSLKLSSVTAADTAVYYCPRGPTMIRGVIDSWGQGTLVTVSS

SEQ ID NO: 1385 - protein, 121 aa, Artificial Sequence
  Description of Artificial Sequence: Synthetic polypeptide
  TBRII-A[TGF-beta-RII]_H1.62
QLQVQESGPGLVKPSETLSLTCTVSGGSISNSYFSWGWIRQPPGKGLEWIGSFYYGEKTFYNPSLKSRATISIDTSKSQFSLKLSSVTAADTAVYYCPRGPTMIRGVIDSWGQGTLVTVSS

SEQ ID NO: 1386 - protein, 121 aa, Artificial Sequence
  Description of Artificial Sequence: Synthetic polypeptide
  TBRII-A[TGF-beta-RII]_H1.63
QLQVQESGPGLVKPSETLSLTCTVSGGSISNSYFSWGWIRQPPGKGLEWIGSFYYGEKTHYNPSLKSRATISIDTSKSQFSLKLSSVTAADTAVYYCPRGPTMIRGVIDSWGQGTLVTVSS

SEQ ID NO: 1387 - protein, 121 aa, Artificial Sequence
  Description of Artificial Sequence: Synthetic polypeptide
  TBRII-A[TGF-beta-RII]_H1.64
QLQVQESGPGLVKPSETLSLTCTVSGGSISNSYFSWGWIRQPPGKGLEWIGSFYYGEKTNYNPSLKSRATISIDTSKSQFSLKLSSVTAADTAVYYCPRGPTMIRGVIDSWGQGTLVTVSS

SEQ ID NO: 1388 - protein, 121 aa, Artificial Sequence
  Description of Artificial Sequence: Synthetic polypeptide
  TBRII-A[TGF-beta-RII]_H1.65
QLQVQESGPGLVKPSETLSLTCTVSGGSISNSYFSWGWIRQPPGKGLEWIGSFYYGEKTSYNPSLKSRATISIDTSKSQFSLKLSSVTAADTAVYYCPRGPTMIRGVIDSWGQGTLVTVSS

SEQ ID NO: 1389 - protein, 121 aa, Artificial Sequence
  Description of Artificial Sequence: Synthetic polypeptide
  TBRII-A[TGF-beta-RII]_H1.66
QLQVQESGPGLVKPSETLSLTCTVSGGSISNSYFSWGWIRQPPGKGLEWIGSFYYGEKTYYAPSLKSRATISIDTSKSQFSLKLSSVTAADTAVYYCPRGPTMIRGVIDSWGQGTLVTVSS

SEQ ID NO: 1390 - protein, 121 aa, Artificial Sequence
  Description of Artificial Sequence: Synthetic polypeptide
  TBRII-A[TGF-beta-RII]_H1.67
QLQVQESGPGLVKPSETLSLTCTVSGGSISNSYFSWGWIRQPPGKGLEWIGSFYYGEKTYYSPSLKSRATISIDTSKSQFSLKLSSVTAADTAVYYCPRGPTMIRGVIDSWGQGTLVTVSS

SEQ ID NO: 1391 - protein, 121 aa, Artificial Sequence
  Description of Artificial Sequence: Synthetic polypeptide
  TBRII-A[TGF-beta-RII]_H1.68
QLQVQESGPGLVKPSETLSLTCTVSGGSISNSYFSWGWIRQPPGKGLEWIGSFYYGEKTYYNPSLESRATISIDTSKSQFSLKLSSVTAADTAVYYCPRGPTMIRGVIDSWGQGTLVTVSS

SEQ ID NO: 1392 - protein, 121 aa, Artificial Sequence
  Description of Artificial Sequence: Synthetic polypeptide
  TBRII-A[TGF-beta-RII]_H1.69
QLQVQESGPGLVKPSETLSLTCTVSGGSISNSYFSWGWIRQPPGKGLEWIGSFYYGEKTYYNPSLQSRATISIDTSKSQFSLKLSSVTAADTAVYYCPRGPTMIRGVIDSWGQGTLVTVSS

SEQ ID NO: 1393 - protein, 121 aa, Artificial Sequence
  Description of Artificial Sequence: Synthetic polypeptide
  TBRII-A[TGF-beta-RII]_H1.70
QLQVQESGPGLVKPSETLSLTCTVSGGSISNSYFSWGWIRQPPGKGLEWIGSFYYGEKTYYNPSLKGRATISIDTSKSQFSLKLSSVTAADTAVYYCPRGPTMIRGVIDSWGQGTLVTVSS

SEQ ID NO: 1394 - protein, 121 aa, Artificial Sequence
  Description of Artificial Sequence: Synthetic polypeptide
  TBRII-A[TGF-beta-RII]_H1.71
QLQVQESGPGLVKPSETLSLTCTVSGGSISNSYFSWGWIRQPPGKGLEWIGSFYYGEKTYYNPSLKSRFTISIDTSKSQFSLKLSSVTAADTAVYYCPRGPTMIRGVIDSWGQGTLVTVSS

SEQ ID NO: 1395 - protein, 121 aa, Artificial Sequence
  Description of Artificial Sequence: Synthetic polypeptide
  TBRII-A[TGF-beta-RII]_H1.72
QLQVQESGPGLVKPSETLSLTCTVSGGSISNSYFSWGWIRQPPGKGLEWIGSFYYGEKTYYNPSLKSRVTISIDTSKSQFSLKLSSVTAADTAVYYCPRGPTMIRGVIDSWGQGTLVTVSS

SEQ ID NO: 1396 - protein, 121 aa, Artificial Sequence
  Description of Artificial Sequence: Synthetic polypeptide
  TBRII-A[TGF-beta-RII]_H1.73
QLQVQESGPGLVKPSETLSLTCTVSGGSISNSYFSWGWIRQPPGKGLEWIGSFYYGEKTYYNPSLKSRATISVDTSKSQFSLKLSSVTAADTAVYYCPRGPTMIRGVIDSWGQGTLVTVSS

SEQ ID NO: 1397 - protein, 121 aa, Artificial Sequence
  Description of Artificial Sequence: Synthetic polypeptide
  TBRII-A[TGF-beta-RII]_H1.74
QLQVQESGPGLVKPSETLSLTCTVSGGSISNSYFSWGWIRQPPGKGLEWIGSFYYGEKTYYNPSLKSRATISIDTSKNQFSLKLSSVTAADTAVYYCPRGPTMIRGVIDSWGQGTLVTVSS

SEQ ID NO: 1398 - protein, 121 aa, Artificial Sequence
  Description of Artificial Sequence: Synthetic polypeptide
  TBRII-A[TGF-beta-RII]_H1.75
QLQVQESGPGLVKPSETLSLTCTVSGGSISNSYFSWGWIRQPPGKGLEWIGSFYYGEKTYYNPSLKSRATISIDTSKSQFSLQLSSVTAADTAVYYCPRGPTMIRGVIDSWGQGTLVTVSS

SEQ ID NO: 1399 - protein, 121 aa, Artificial Sequence
  Description of Artificial Sequence: Synthetic polypeptide
  TBRII-A[TGF-beta-RII]_H1.76
QLQVQESGPGLVKPSETLSLTCTVSGGSISNSYFSWGWIRQPPGKGLEWIGSFYYGEKTYYNPSLKSRATISIDTSKSQFSLKLSSVTAEDTAVYYCPRGPTMIRGVIDSWGQGTLVTVSS

SEQ ID NO: 1400 - protein, 121 aa, Artificial Sequence
  Description of Artificial Sequence: Synthetic polypeptide
  TBRII-A[TGF-beta-RII]_H1.77
QLQVQESGPGLVKPSETLSLTCTVSGGSISNSYFSWGWIRQPPGKGLEWIGSFYYGEKTYYNPSLKSRATISIDTSKSQFSLKLSSVTAVDTAVYYCPRGPTMIRGVIDSWGQGTLVTVSS

SEQ ID NO: 1401 - protein, 121 aa, Artificial Sequence
  Description of Artificial Sequence: Synthetic polypeptide
  TBRII-A[TGF-beta-RII]_H1.78
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCARGPTMIRGVIDSWGQGTLVTVSS

SEQ ID NO: 1402 - protein, 121 aa, Artificial Sequence
  Description of Artificial Sequence: Synthetic polypeptide
  TBRII-A[TGF-beta-RII]_H1.79
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPAMIRGVIDSWGQGTLVTVSS

SEQ ID NO: 1403 - protein, 121 aa, Artificial Sequence
  Description of Artificial Sequence: Synthetic polypeptide
  TBRII-A[TGF-beta-RII]_H1.80
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPDMIRGVIDSWGQGTLVTVSS

SEQ ID NO: 1404 - protein, 121 aa, Artificial Sequence
  Description of Artificial Sequence: Synthetic polypeptide
  TBRII-A[TGF-beta-RII]_H1.81
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPNMIRGVIDSWGQGTLVTVSS

SEQ ID NO: 1405 - protein, 121 aa, Artificial Sequence
  Description of Artificial Sequence: Synthetic polypeptide
  TBRII-A[TGF-beta-RII]_H1.82
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPSMIRGVIDSWGQGTLVTVSS

SEQ ID NO: 1406 - protein, 121 aa, Artificial Sequence
  Description of Artificial Sequence: Synthetic polypeptide
  TBRII-A[TGF-beta-RII]_H1.83
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTAIRGVIDSWGQGTLVTVSS

SEQ ID NO: 1407 - protein, 121 aa, Artificial Sequence
  Description of Artificial Sequence: Synthetic polypeptide
  TBRII-A[TGF-beta-RII]_H1.84
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTEIRGVIDSWGQGTLVTVSS

SEQ ID NO: 1408 - protein, 121 aa, Artificial Sequence
  Description of Artificial Sequence: Synthetic polypeptide
  TBRII-A[TGF-beta-RII]_H1.85
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTSIRGVIDSWGQGTLVTVSS

SEQ ID NO: 1409 - protein, 121 aa, Artificial Sequence
  Description of Artificial Sequence: Synthetic polypeptide
  TBRII-A[TGF-beta-RII]_H1.86
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTTIRGVIDSWGQGTLVTVSS

SEQ ID NO: 1410 - protein, 121 aa, Artificial Sequence
  Description of Artificial Sequence: Synthetic polypeptide
  TBRII-A[TGF-beta-RII]_H1.87
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTQIRGVIDSWGQGTLVTVSS

SEQ ID NO: 1411 - protein, 121 aa, Artificial Sequence
  Description of Artificial Sequence: Synthetic polypeptide
  TBRII-A[TGF-beta-RII]_H1.88
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMARGVIDSWGQGTLVTVSS

SEQ ID NO: 1412 - protein, 121 aa, Artificial Sequence
  Description of Artificial Sequence: Synthetic polypeptide
  TBRII-A[TGF-beta-RII]_H1.89
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMDRGVIDSWGQGTLVTVSS

SEQ ID NO: 1413 - protein, 121 aa, Artificial Sequence
  Description of Artificial Sequence: Synthetic polypeptide
  TBRII-A[TGF-beta-RII]_H1.90
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMNRGVIDSWGQGTLVTVSS

SEQ ID NO: 1414 - protein, 121 aa, Artificial Sequence
  Description of Artificial Sequence: Synthetic polypeptide
  TBRII-A[TGF-beta-RII]_H1.91
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMVRGVIDSWGQGTLVTVSS

SEQ ID NO: 1415 - protein, 121 aa, Artificial Sequence
  Description of Artificial Sequence: Synthetic polypeptide
  TBRII-A[TGF-beta-RII]_H1.92
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIAGVIDSWGQGTLVTVSS

SEQ ID NO: 1416 - protein, 121 aa, Artificial Sequence
  Description of Artificial Sequence: Synthetic polypeptide
  TBRII-A[TGF-beta-RII]_H1.93
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIHGVIDSWGQGTLVTVSS

SEQ ID NO: 1417 - protein, 121 aa, Artificial Sequence
  Description of Artificial Sequence: Synthetic polypeptide
  TBRII-A[TGF-beta-RII]_H1.94
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIEGVIDSWGQGTLVTVSS

SEQ ID NO: 1418 - protein, 121 aa, Artificial Sequence
  Description of Artificial Sequence: Synthetic polypeptide
  TBRII-A[TGF-beta-RII]_H1.95
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIKGVIDSWGQGTLVTVSS

SEQ ID NO: 1419 - protein, 121 aa, Artificial Sequence
  Description of Artificial Sequence: Synthetic polypeptide
  TBRII-A[TGF-beta-RII]_H1.96
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIQGVIDSWGQGTLVTVSS

SEQ ID NO: 1420 - protein, 121 aa, Artificial Sequence
  Description of Artificial Sequence: Synthetic polypeptide
  TBRII-A[TGF-beta-RII]_H1.97
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMISGVIDSWGQGTLVTVSS

SEQ ID NO: 1421 - protein, 121 aa, Artificial Sequence
  Description of Artificial Sequence: Synthetic polypeptide
  TBRII-A[TGF-beta-RII]_H1.98
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGAIDSWGQGTLVTVSS

SEQ ID NO: 1422 - protein, 121 aa, Artificial Sequence
  Description of Artificial Sequence: Synthetic polypeptide
  TBRII-A[TGF-beta-RII]_H1.99
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGSIDSWGQGTLVTVSS

SEQ ID NO: 1423 - protein, 121 aa, Artificial Sequence
  Description of Artificial Sequence: Synthetic polypeptide
  TBRII-A[TGF-beta-RII]_H1.100
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVFDSWGQGTLVTVSS

SEQ ID NO: 1424 - protein, 121 aa, Artificial Sequence
  Description of Artificial Sequence: Synthetic polypeptide
  TBRII-A[TGF-beta-RII]_H1.101
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVMDSWGQGTLVTVSS

SEQ ID NO: 1425 - protein, 121 aa, Artificial Sequence
  Description of Artificial Sequence: Synthetic polypeptide
  TBRII-A[TGF-beta-RII]_H1.102
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDHWGQGTLVTVSS

SEQ ID NO: 1426 - protein, 121 aa, Artificial Sequence
  Description of Artificial Sequence: Synthetic polypeptide
  TBRII-A[TGF-beta-RII]_H1.103
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDLWGQGTLVTVSS

SEQ ID NO: 1427 - protein, 121 aa, Artificial Sequence
  Description of Artificial Sequence: Synthetic polypeptide
  TBRII-A[TGF-beta-RII]_H1.104
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDVWGQGTLVTVSS

SEQ ID NO: 1428 - protein, 121 aa, Artificial Sequence
  Description of Artificial Sequence: Synthetic polypeptide
  TBRII-A[TGF-beta-RII]_H1.105
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDYWGQGTLVTVSS

SEQ ID NO: 1429 - protein, 121 aa, Artificial Sequence
  Description of Artificial Sequence: Synthetic polypeptide
  TBRII-A[TGF-beta-RII]_H1.106
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTMVTVSS

SEQ ID NO: 1430 - protein, 121 aa, Artificial Sequence
  Description of Artificial Sequence: Synthetic polypeptide
  TBRII-A[TGF-beta-RII]_H1.107
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTTVTVSS

SEQ ID NO: 1431 - protein, 121 aa, Artificial Sequence
  Description of Artificial Sequence: Synthetic polypeptide
  TBRII-A[TGF-beta-RII]_H1.108
QLQVQESGPGLVKPSETLSLTCTVSGGSISNSYFSWAWVRQPPGKGLEWIGSFYYGGKIYYNPSLKSRATISIDTSKNQFSLKLSSVTAADTAVYYCPRGPTMIRGVIDSWGQGTLVTVSS

SEQ ID NO: 1432 - protein, 121 aa, Artificial Sequence
  Description of Artificial Sequence: Synthetic polypeptide
  TBRII-A[TGF-beta-RII]_H1.109
QLQVQESGPGLVKPSETLSLTCTVSGGSISNSYFSWAWVRQPPGKGLEWIGSFYYGGKIYYNPSLKSRATISIDTSKSQFSLKLSSVTAADTAVYYCARGPTMIRGVIDSWGQGTLVTVSS

SEQ ID NO: 1433 - protein, 121 aa, Artificial Sequence
  Description of Artificial Sequence: Synthetic polypeptide
  TBRII-A[TGF-beta-RII]_H1.110
QLQVQESGPGLVKPSETLSLTCTVSGGSISNSYFSWAWVRQPPGKGLEWIGSFYYGGKIYYNPSLKSRATISIDTSKSQFSLKLSSVTAADTAVYYCPRGPTMIRGVMDSWGQGTLVTVSS

SEQ ID NO: 1434 - protein, 121 aa, Artificial Sequence
  Description of Artificial Sequence: Synthetic polypeptide
  TBRII-A[TGF-beta-RII]_H1.111
QLQVQESGPGLVKPSETLSLTCTVSGGSISNSYFSWAWVRQPPGKGLEWIGSFYYGGKIYYNPSLKSRATISIDTSKSQFSLKLSSVTAADTAVYYCPRGPTMIRGVIDHWGQGTLVTVSS

SEQ ID NO: 1435 - protein, 121 aa, Artificial Sequence
  Description of Artificial Sequence: Synthetic polypeptide
  TBRII-A[TGF-beta-RII]_H1.112
QLQVQESGPGLVKPSETLSLTCTVSGGSISNSYFSWAWVRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1436 - protein, 121 aa, Artificial Sequence
  Description of Artificial Sequence: Synthetic polypeptide
  TBRII-A[TGF-beta-RII]_H1.113
QLQVQESGPGLVKPSETLSLTCTVSGGSISNSYFSWAWVRQPPGKGLEWIGSFYYGGKTYYNPSLKSRATISIDTSKNQFSLKLSSVTAADTAVYYCPRGPTMIRGVMDSWGQGTLVTVSS

SEQ ID NO: 1437 - protein, 121 aa, Artificial Sequence
  Description of Artificial Sequence: Synthetic polypeptide
  TBRII-A[TGF-beta-RII]_H1.114
QLQVQESGPGLVKPSETLSLTCTVSGGSISNSYFSWAWVRQPPGKGLEWIGSFYYGGKTYYNPSLKSRATISIDTSKNQFSLKLSSVTAADTAVYYCPRGPTMIRGVIDHWGQGTLVTVSS

SEQ ID NO: 1438 - protein, 121 aa, Artificial Sequence
  Description of Artificial Sequence: Synthetic polypeptide
  TBRII-A[TGF-beta-RII]_H1.115
QLQVQESGPGLVKPSETLSLTCTVSGGSISNSYFSWAWVRQPPGKGLEWIGSFYYGGKTYYNPSLKSRATISIDTSKSQFSLKLSSVTAADTAVYYCARGPTMIRGVMDSWGQGTLVTVSS

SEQ ID NO: 1439 - protein, 121 aa, Artificial Sequence
  Description of Artificial Sequence: Synthetic polypeptide
  TBRII-A[TGF-beta-RII]_H1.116
QLQVQESGPGLVKPSETLSLTCTVSGGSISNSYFSWAWVRQPPGKGLEWIGSFYYGGKTYYNPSLKSRATISIDTSKSQFSLKLSSVTAADTAVYYCARGPTMIRGVIDHWGQGTLVTVSS

SEQ ID NO: 1440 - protein, 121 aa, Artificial Sequence
  Description of Artificial Sequence: Synthetic polypeptide
  TBRII-A[TGF-beta-RII]_H1.117
QLQVQESGPGLVKPSETLSLTCTVSGGSISNSYFSWAWVRQPPGKGLEWIGSFYYGGKTYYNPSLKSRATISIDTSKSQFSLKLSSVTAADTAVYYCPRGPTMIRGVMDHWGQGTLVTVSS

SEQ ID NO: 1441 - protein, 121 aa, Artificial Sequence
  Description of Artificial Sequence: Synthetic polypeptide
  TBRII-A[TGF-beta-RII]_H1.118
QLQVQESGPGLVKPSETLSLTCTVSGGSISNSYFSWAWVRQPPGKGLEWIGSFYYGEKIYYNPSLKSRATISIDTSKNQFSLKLSSVTAADTAVYYCARGPTMIRGVIDSWGQGTLVTVSS

SEQ ID NO: 1442 - protein, 121 aa, Artificial Sequence
  Description of Artificial Sequence: Synthetic polypeptide
  TBRII-A[TGF-beta-RII]_H1.119
QLQVQESGPGLVKPSETLSLTCTVSGGSISNSYFSWAWVRQPPGKGLEWIGSFYYGEKIYYNPSLKSRATISIDTSKNQFSLKLSSVTAADTAVYYCPRGPTMIRGVMDSWGQGTLVTVSS

SEQ ID NO: 1443 - protein, 121 aa, Artificial Sequence
  Description of Artificial Sequence: Synthetic polypeptide
  TBRII-A[TGF-beta-RII]_H1.120
QLQVQESGPGLVKPSETLSLTCTVSGGSISNSYFSWAWVRQPPGKGLEWIGSFYYGEKIYYNPSLKSRATISIDTSKNQFSLKLSSVTAADTAVYYCPRGPTMIRGVIDHWGQGTLVTVSS

SEQ ID NO: 1444 - protein, 121 aa, Artificial Sequence
  Description of Artificial Sequence: Synthetic polypeptide
  TBRII-A[TGF-beta-RII]_H1.121
QLQVQESGPGLVKPSETLSLTCTVSGGSISNSYFSWAWVRQPPGKGLEWIGSFYYGEKIYYNPSLKSRATISIDTSKSQFSLKLSSVTAADTAVYYCARGPTMIRGVMDSWGQGTLVTVSS

SEQ ID NO: 1445 - protein, 121 aa, Artificial Sequence
  Description of Artificial Sequence: Synthetic polypeptide
  TBRII-A[TGF-beta-RII]_H1.122
QLQVQESGPGLVKPSETLSLTCTVSGGSISNSYFSWAWVRQPPGKGLEWIGSFYYGEKIYYNPSLKSRATISIDTSKSQFSLKLSSVTAADTAVYYCARGPTMIRGVIDHWGQGTLVTVSS

SEQ ID NO: 1446 - protein, 121 aa, Artificial Sequence
  Description of Artificial Sequence: Synthetic polypeptide
  TBRII-A[TGF-beta-RII]_H1.123
QLQVQESGPGLVKPSETLSLTCTVSGGSISNSYFSWAWVRQPPGKGLEWIGSFYYGEKIYYNPSLKSRATISIDTSKSQFSLKLSSVTAADTAVYYCPRGPTMIRGVMDHWGQGTLVTVSS

SEQ ID NO: 1447 - protein, 121 aa, Artificial Sequence
  Description of Artificial Sequence: Synthetic polypeptide
  TBRII-A[TGF-beta-RII]_H1.124
QLQVQESGPGLVKPSETLSLTCTVSGGSISNSYFSWAWVRQPPGKGLEWIGSFYYGEKTYYNPSLKSRATISIDTSKNQFSLKLSSVTAADTAVYYCARGPTMIRGVMDSWGQGTLVTVSS

SEQ ID NO: 1448 - protein, 121 aa, Artificial Sequence
  Description of Artificial Sequence: Synthetic polypeptide
  TBRII-A[TGF-beta-RII]_H1.125
QLQVQESGPGLVKPSETLSLTCTVSGGSISNSYFSWAWVRQPPGKGLEWIGSFYYGEKTYYNPSLKSRATISIDTSKNQFSLKLSSVTAADTAVYYCARGPTMIRGVIDHWGQGTLVTVSS

SEQ ID NO: 1449 - protein, 121 aa, Artificial Sequence
  Description of Artificial Sequence: Synthetic polypeptide
  TBRII-A[TGF-beta-RII]_H1.126
QLQVQESGPGLVKPSETLSLTCTVSGGSISNSYFSWAWVRQPPGKGLEWIGSFYYGEKTYYNPSLKSRATISIDTSKNQFSLKLSSVTAADTAVYYCPRGPTMIRGVMDHWGQGTLVTVSS

SEQ ID NO: 1450 - protein, 121 aa, Artificial Sequence
  Description of Artificial Sequence: Synthetic polypeptide
  TBRII-A[TGF-beta-RII]_H1.127
QLQVQESGPGLVKPSETLSLTCTVSGGSISNSYFSWAWVRQPPGKGLEWIGSFYYGEKTYYNPSLKSRATISIDTSKSQFSLKLSSVTAADTAVYYCARGPTMIRGVMDHWGQGTLVTVSS

SEQ ID NO: 1451 - protein, 121 aa, Artificial Sequence
  Description of Artificial Sequence: Synthetic polypeptide
  TBRII-A[TGF-beta-RII]_H1.128
QLQVQESGPGLVKPSETLSLTCTVSGGSISNSYFSWAWIRQPPGKGLEWIGSFYYGGKIYYNPSLKSRATISIDTSKNQFSLKLSSVTAADTAVYYCARGPTMIRGVIDSWGQGTLVTVSS

SEQ ID NO: 1452 - protein, 121 aa, Artificial Sequence
  Description of Artificial Sequence: Synthetic polypeptide
  TBRII-A[TGF-beta-RII]_H1.129
QLQVQESGPGLVKPSETLSLTCTVSGGSISNSYFSWAWIRQPPGKGLEWIGSFYYGGKIYYNPSLKSRATISIDTSKNQFSLKLSSVTAADTAVYYCPRGPTMIRGVMDSWGQGTLVTVSS

SEQ ID NO: 1453 - protein, 121 aa, Artificial Sequence
  Description of Artificial Sequence: Synthetic polypeptide
  TBRII-A[TGF-beta-RII]_H1.130
QLQVQESGPGLVKPSETLSLTCTVSGGSISNSYFSWAWIRQPPGKGLEWIGSFYYGGKIYYNPSLKSRATISIDTSKNQFSLKLSSVTAADTAVYYCPRGPTMIRGVIDHWGQGTLVTVSS

SEQ ID NO: 1454 - protein, 121 aa, Artificial Sequence
  Description of Artificial Sequence: Synthetic polypeptide
  TBRII-A[TGF-beta-RII]_H1.131
QLQVQESGPGLVKPSETLSLTCTVSGGSISNSYFSWAWIRQPPGKGLEWIGSFYYGGKIYYNPSLKSRATISIDTSKSQFSLKLSSVTAADTAVYYCARGPTMIRGVMDSWGQGTLVTVSS

SEQ ID NO: 1455 - protein, 121 aa, Artificial Sequence
  Description of Artificial Sequence: Synthetic polypeptide
  TBRII-A[TGF-beta-RII]_H1.132
QLQVQESGPGLVKPSETLSLTCTVSGGSISNSYFSWAWIRQPPGKGLEWIGSFYYGGKIYYNPSLKSRATISIDTSKSQFSLKLSSVTAADTAVYYCARGPTMIRGVIDHWGQGTLVTVSS

SEQ ID NO: 1456 - protein, 121 aa, Artificial Sequence
  Description of Artificial Sequence: Synthetic polypeptide
  TBRII-A[TGF-beta-RII]_H1.133
QLQVQESGPGLVKPSETLSLTCTVSGGSISNSYFSWAWIRQPPGKGLEWIGSFYYGGKIYYNPSLKSRATISIDTSKSQFSLKLSSVTAADTAVYYCPRGPTMIRGVMDHWGQGTLVTVSS

SEQ ID NO: 1457 - protein, 121 aa, Artificial Sequence
  Description of Artificial Sequence: Synthetic polypeptide
  TBRII-A[TGF-beta-RII]_H1.134
QLQVQESGPGLVKPSETLSLTCTVSGGSISNSYFSWAWIRQPPGKGLEWIGSFYYGGKTYYNPSLKSRATISIDTSKNQFSLKLSSVTAADTAVYYCARGPTMIRGVMDSWGQGTLVTVSS

SEQ ID NO: 1458 - protein, 121 aa, Artificial Sequence
  Description of Artificial Sequence: Synthetic polypeptide
  TBRII-A[TGF-beta-RII]_H1.135
QLQVQESGPGLVKPSETLSLTCTVSGGSISNSYFSWAWIRQPPGKGLEWIGSFYYGGKTYYNPSLKSRATISIDTSKNQFSLKLSSVTAADTAVYYCARGPTMIRGVIDHWGQGTLVTVSS

SEQ ID NO: 1459 - protein, 121 aa, Artificial Sequence
  Description of Artificial Sequence: Synthetic polypeptide
  TBRII-A[TGF-beta-RII]_H1.136
QLQVQESGPGLVKPSETLSLTCTVSGGSISNSYFSWAWIRQPPGKGLEWIGSFYYGGKTYYNPSLKSRATISIDTSKNQFSLKLSSVTAADTAVYYCPRGPTMIRGVMDHWGQGTLVTVSS

SEQ ID NO: 1460 - protein, 121 aa, Artificial Sequence
  Description of Artificial Sequence: Synthetic polypeptide
  TBRII-A[TGF-beta-RII]_H1.137
QLQVQESGPGLVKPSETLSLTCTVSGGSISNSYFSWAWIRQPPGKGLEWIGSFYYGGKTYYNPSLKSRATISIDTSKSQFSLKLSSVTAADTAVYYCARGPTMIRGVMDHWGQGTLVTVSS

SEQ ID NO: 1461 - protein, 121 aa, Artificial Sequence
  Description of Artificial Sequence: Synthetic polypeptide
  TBRII-A[TGF-beta-RII]_H1.138
QLQVQESGPGLVKPSETLSLTCTVSGGSISNSYFSWAWIRQPPGKGLEWIGSFYYGEKIYYNPSLKSRATISIDTSKNQFSLKLSSVTAADTAVYYCARGPTMIRGVMDSWGQGTLVTVSS

SEQ ID NO: 1462 - protein, 121 aa, Artificial Sequence
  Description of Artificial Sequence: Synthetic polypeptide
  TBRII-A[TGF-beta-RII]_H1.139
QLQVQESGPGLVKPSETLSLTCTVSGGSISNSYFSWAWIRQPPGKGLEWIGSFYYGEKIYYNPSLKSRATISIDTSKNQFSLKLSSVTAADTAVYYCARGPTMIRGVIDHWGQGTLVTVSS

SEQ ID NO: 1463 - protein, 121 aa, Artificial Sequence
  Description of Artificial Sequence: Synthetic polypeptide
  TBRII-A[TGF-beta-RII]_H1.140
QLQVQESGPGLVKPSETLSLTCTVSGGSISNSYFSWAWIRQPPGKGLEWIGSFYYGEKIYYNPSLKSRATISIDTSKNQFSLKLSSVTAADTAVYYCPRGPTMIRGVMDHWGQGTLVTVSS

SEQ ID NO: 1464 - protein, 121 aa, Artificial Sequence
  Description of Artificial Sequence: Synthetic polypeptide
  TBRII-A[TGF-beta-RII]_H1.141
QLQVQESGPGLVKPSETLSLTCTVSGGSISNSYFSWAWIRQPPGKGLEWIGSFYYGEKIYYNPSLKSRATISIDTSKSQFSLKLSSVTAADTAVYYCARGPTMIRGVMDHWGQGTLVTVSS

SEQ ID NO: 1465 - protein, 121 aa, Artificial Sequence
  Description of Artificial Sequence: Synthetic polypeptide
  TBRII-A[TGF-beta-RII]_H1.142
QLQVQESGPGLVKPSETLSLTCTVSGGSISNSYFSWAWIRQPPGKGLEWIGSFYYGEKTYYNPSLKSRATISIDTSKNQFSLKLSSVTAADTAVYYCARGPTMIRGVMDHWGQGTLVTVSS

SEQ ID NO: 1466 - protein, 121 aa, Artificial Sequence
  Description of Artificial Sequence: Synthetic polypeptide
  TBRII-A[TGF-beta-RII]_H1.143
QLQVQESGPGLVKPSETLSLTCTVSGGSISNSYFSWGWVRQPPGKGLEWIGSFYYGGKIYYNPSLKSRATISIDTSKNQFSLKLSSVTAADTAVYYCARGPTMIRGVIDSWGQGTLVTVSS

SEQ ID NO: 1467 - protein, 121 aa, Artificial Sequence
  Description of Artificial Sequence: Synthetic polypeptide
  TBRII-A[TGF-beta-RII]_H1.144
QLQVQESGPGLVKPSETLSLTCTVSGGSISNSYFSWGWVRQPPGKGLEWIGSFYYGGKIYYNPSLKSRATISIDTSKNQFSLKLSSVTAADTAVYYCPRGPTMIRGVMDSWGQGTLVTVSS

SEQ ID NO: 1468 - protein, 121 aa, Artificial Sequence
  Description of Artificial Sequence: Synthetic polypeptide
  TBRII-A[TGF-beta-RII]_H1.145
QLQVQESGPGLVKPSETLSLTCTVSGGSISNSYFSWGWVRQPPGKGLEWIGSFYYGGKIYYNPSLKSRATISIDTSKNQFSLKLSSVTAADTAVYYCPRGPTMIRGVIDHWGQGTLVTVSS

SEQ ID NO: 1469 - protein, 121 aa, Artificial Sequence
  Description of Artificial Sequence: Synthetic polypeptide
  TBRII-A[TGF-beta-RII]_H1.146
QLQVQESGPGLVKPSETLSLTCTVSGGSISNSYFSWGWVRQPPGKGLEWIGSFYYGGKIYYNPSLKSRATISIDTSKSQFSLKLSSVTAADTAVYYCARGPTMIRGVMDSWGQGTLVTVSS

SEQ ID NO: 1470 - protein, 121 aa, Artificial Sequence
  Description of Artificial Sequence: Synthetic polypeptide
  TBRII-A[TGF-beta-RII]_H1.147
QLQVQESGPGLVKPSETLSLTCTVSGGSISNSYFSWGWVRQPPGKGLEWIGSFYYGGKIYYNPSLKSRATISIDTSKSQFSLKLSSVTAADTAVYYCARGPTMIRGVIDHWGQGTLVTVSS

SEQ ID NO: 1471 - protein, 121 aa, Artificial Sequence
  Description of Artificial Sequence: Synthetic polypeptide
  TBRII-A[TGF-beta-RII]_H1.148
QLQVQESGPGLVKPSETLSLTCTVSGGSISNSYFSWGWVRQPPGKGLEWIGSFYYGGKIYYNPSLKSRATISIDTSKSQFSLKLSSVTAADTAVYYCPRGPTMIRGVMDHWGQGTLVTVSS

SEQ ID NO: 1472 - protein, 121 aa, Artificial Sequence
  Description of Artificial Sequence: Synthetic polypeptide
  TBRII-A[TGF-beta-RII]_H1.149
QLQVQESGPGLVKPSETLSLTCTVSGGSISNSYFSWGWVRQPPGKGLEWIGSFYYGGKTYYNPSLKSRATISIDTSKNQFSLKLSSVTAADTAVYYCARGPTMIRGVMDSWGQGTLVTVSS

SEQ ID NO: 1473 - protein, 121 aa, Artificial Sequence
  Description of Artificial Sequence: Synthetic polypeptide
  TBRII-A[TGF-beta-RII]_H1.150
QLQVQESGPGLVKPSETLSLTCTVSGGSISNSYFSWGWVRQPPGKGLEWIGSFYYGGKTYYNPSLKSRATISIDTSKNQFSLKLSSVTAADTAVYYCARGPTMIRGVIDHWGQGTLVTVSS

SEQ ID NO: 1474 - protein, 121 aa, Artificial Sequence
  Description of Artificial Sequence: Synthetic polypeptide
  TBRII-A[TGF-beta-RII]_H1.151
QLQVQESGPGLVKPSETLSLTCTVSGGSISNSYFSWGWVRQPPGKGLEWIGSFYYGGKTYYNPSLKSRATISIDTSKNQFSLKLSSVTAADTAVYYCPRGPTMIRGVMDHWGQGTLVTVSS

SEQ ID NO: 1475 - protein, 121 aa, Artificial Sequence
  Description of Artificial Sequence: Synthetic polypeptide
  TBRII-A[TGF-beta-RII]_H1.152
QLQVQESGPGLVKPSETLSLTCTVSGGSISNSYFSWGWVRQPPGKGLEWIGSFYYGGKTYYNPSLKSRATISIDTSKSQFSLKLSSVTAADTAVYYCARGPTMIRGVMDHWGQGTLVTVSS

SEQ ID NO: 1476 - protein, 121 aa, Artificial Sequence
  Description of Artificial Sequence: Synthetic polypeptide
  TBRII-A[TGF-beta-RII]_H1.153
QLQVQESGPGLVKPSETLSLTCTVSGGSISNSYFSWGWVRQPPGKGLEWIGSFYYGEKIYYNPSLKSRATISIDTSKNQFSLKLSSVTAADTAVYYCARGPTMIRGVMDSWGQGTLVTVSS

SEQ ID NO: 1477 - protein, 121 aa, Artificial Sequence
  Description of Artificial Sequence: Synthetic polypeptide
  TBRII-A[TGF-beta-RII]_H1.154
QLQVQESGPGLVKPSETLSLTCTVSGGSISNSYFSWGWVRQPPGKGLEWIGSFYYGEKIYYNPSLKSRATISIDTSKNQFSLKLSSVTAADTAVYYCARGPTMIRGVIDHWGQGTLVTVSS

SEQ ID NO: 1478 - protein, 121 aa, Artificial Sequence
  Description of Artificial Sequence: Synthetic polypeptide
  TBRII-A[TGF-beta-RII]_H1.155
QLQVQESGPGLVKPSETLSLTCTVSGGSISNSYFSWGWVRQPPGKGLEWIGSFYYGEKIYYNPSLKSRATISIDTSKNQFSLKLSSVTAADTAVYYCPRGPTMIRGVMDHWGQGTLVTVSS

SEQ ID NO: 1479 - protein, 121 aa, Artificial Sequence
  Description of Artificial Sequence: Synthetic polypeptide
  TBRII-A[TGF-beta-RII]_H1.156
QLQVQESGPGLVKPSETLSLTCTVSGGSISNSYFSWGWVRQPPGKGLEWIGSFYYGEKIYYNPSLKSRATISIDTSKSQFSLKLSSVTAADTAVYYCARGPTMIRGVMDHWGQGTLVTVSS

SEQ ID NO: 1480 - protein, 121 aa, Artificial Sequence
  Description of Artificial Sequence: Synthetic polypeptide
  TBRII-A[TGF-beta-RII]_H1.157
QLQVQESGPGLVKPSETLSLTCTVSGGSISNSYFSWGWVRQPPGKGLEWIGSFYYGEKTYYNPSLKSRATISIDTSKNQFSLKLSSVTAADTAVYYCARGPTMIRGVMDHWGQGTLVTVSS

SEQ ID NO: 1481 - protein, 121 aa, Artificial Sequence
  Description of Artificial Sequence: Synthetic polypeptide
  TBRII-A[TGF-beta-RII]_H1.158
QLQVQESGPGLVKPSETLSLTCTVSGGSISNSYFSWGWIRQPPGKGLEWIGSFYYGGKIYYNPSLKSRATISIDTSKNQFSLKLSSVTAADTAVYYCARGPTMIRGVMDSWGQGTLVTVSS

SEQ ID NO: 1482 - protein, 121 aa, Artificial Sequence
  Description of Artificial Sequence: Synthetic polypeptide
  TBRII-A[TGF-beta-RII]_H1.159
QLQVQESGPGLVKPSETLSLTCTVSGGSISNSYFSWGWIRQPPGKGLEWIGSFYYGGKIYYNPSLKSRATISIDTSKNQFSLKLSSVTAADTAVYYCARGPTMIRGVIDHWGQGTLVTVSS

SEQ ID NO: 1483 - protein, 121 aa, Artificial Sequence
  Description of Artificial Sequence: Synthetic polypeptide
  TBRII-A[TGF-beta-RII]_H1.160
QLQVQESGPGLVKPSETLSLTCTVSGGSISNSYFSWGWIRQPPGKGLEWIGSFYYGGKIYYNPSLKSRATISIDTSKNQFSLKLSSVTAADTAVYYCPRGPTMIRGVMDHWGQGTLVTVSS

SEQ ID NO: 1484 - protein, 121 aa, Artificial Sequence
  Description of Artificial Sequence: Synthetic polypeptide
  TBRII-A[TGF-beta-RII]_H1.161
QLQVQESGPGLVKPSETLSLTCTVSGGSISNSYFSWGWIRQPPGKGLEWIGSFYYGGKIYYNPSLKSRATISIDTSKSQFSLKLSSVTAADTAVYYCARGPTMIRGVMDHWGQGTLVTVSS

SEQ ID NO: 1485 - protein, 121 aa, Artificial Sequence
  Description of Artificial Sequence: Synthetic polypeptide
  TBRII-A[TGF-beta-RII]_H1.162
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTMIRGVMDHWGQGTLVTVSS

SEQ ID NO: 1486 - protein, 121 aa, Artificial Sequence
  Description of Artificial Sequence: Synthetic polypeptide
  TBRII-A[TGF-beta-RII]_H1.163
QLQVQESGPGLVKPSETLSLTCTVSGGSISNSYFSWGWIRQPPGKGLEWIGSFYYGEKIYYNPSLKSRATISIDTSKNQFSLKLSSVTAADTAVYYCARGPTMIRGVMDHWGQGTLVTVSS

SEQ ID NO: 1487 - protein, 121 aa, Artificial Sequence
  Description of Artificial Sequence: Synthetic polypeptide
  TBRII-A[TGF-beta-RII]_H1.164
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTTNRGVIDSWGQGTLVTVSS

SEQ ID NO: 1488 - protein, 121 aa, Artificial Sequence
  Description of Artificial Sequence: Synthetic polypeptide
  TBRII-A[TGF-beta-RII]_H1.165
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTTIRGVIDLWGQGTLVTVSS

SEQ ID NO: 1489 - protein, 121 aa, Artificial Sequence
  Description of Artificial Sequence: Synthetic polypeptide
  TBRII-A[TGF-beta-RII]_H1.166
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTMNRGVIDLWGQGTLVTVSS

SEQ ID NO: 1490 - protein, 121 aa, Artificial Sequence
  Description of Artificial Sequence: Synthetic polypeptide
  TBRII-A[TGF-beta-RII]_H1.167
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTTNRGVIDLWGQGTLVTVSS

SEQ ID NO: 1491 - protein, 121 aa, Artificial Sequence
  Description of Artificial Sequence: Synthetic polypeptide
  TBRII-A[TGF-beta-RII]_H1.168
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTTNRGVIDLWGQGTLVTVSS

SEQ ID NO: 1492 - protein, 121 aa, Artificial Sequence
  Description of Artificial Sequence: Synthetic polypeptide
  TBRII-A[TGF-beta-RII]_H1.169
QLQVQESGPGLVKPSETLSLTCTVSGGSISNSYFTWGWIRQPPGKGLEWIGSFYYGEKTYYNPSLKSRATISIDTSKSQFSLKLSSVTAADTAVYYCARGPTMIRGVIDSWGQGTLVTVSS

SEQ ID NO: 1493 - protein, 121 aa, Artificial Sequence
  Description of Artificial Sequence: Synthetic polypeptide
  TBRII-A[TGF-beta-RII]_H1.170
QLQVQESGPGLVKPSETLSLTCTVSGGSISNSYFSWHWIRQPPGKGLEWIGSFYYGEKTYYNPSLKSRATISIDTSKSQFSLKLSSVTAADTAVYYCARGPTMIRGVIDSWGQGTLVTVSS

SEQ ID NO: 1494 - protein, 121 aa, Artificial Sequence
  Description of Artificial Sequence: Synthetic polypeptide
  TBRII-A[TGF-beta-RII]_H1.171
QLQVQESGPGLVKPSETLSLTCTVSGGSISNSYFSWSWIRQPPGKGLEWIGSFYYGEKTYYNPSLKSRATISIDTSKSQFSLKLSSVTAADTAVYYCARGPTMIRGVIDSWGQGTLVTVSS

SEQ ID NO: 1495 - protein, 121 aa, Artificial Sequence
  Description of Artificial Sequence: Synthetic polypeptide
  TBRII-A[TGF-beta-RII]_H1.172
QLQVQESGPGLVKPSETLSLTCTVSGGSISNSYFYWGWIRQPPGKGLEWIGSFYYGEKTYYNPSLKSRATISIDTSKSQFSLKLSSVTAADTAVYYCARGPTMIRGVIDSWGQGTLVTVSS

SEQ ID NO: 1496 - protein, 121 aa, Artificial Sequence
  Description of Artificial Sequence: Synthetic polypeptide
  TBRII-A[TGF-beta-RII]_H1.173
QLQVQESGPGLVKPSETLSLTCTVSGGSISNSYFTWGWIRQPPGKGLEWIGSFYYGGKTYYNPSLKSRATISIDTSKSQFSLKLSSVTAADTAVYYCARGPTMIRGVIDSWGQGTLVTVSS

SEQ ID NO: 1497 - protein, 121 aa, Artificial Sequence
  Description of Artificial Sequence: Synthetic polypeptide
  TBRII-A[TGF-beta-RII]_H1.174
QLQVQESGPGLVKPSETLSLTCTVSGGSISNSYFSWHWIRQPPGKGLEWIGSFYYGGKTYYNPSLKSRATISIDTSKSQFSLKLSSVTAADTAVYYCARGPTMIRGVIDSWGQGTLVTVSS

SEQ ID NO: 1498 - protein, 121 aa, Artificial Sequence
  Description of Artificial Sequence: Synthetic polypeptide
  TBRII-A[TGF-beta-RII]_H1.175
QLQVQESGPGLVKPSETLSLTCTVSGGSISNSYFSWSWIRQPPGKGLEWIGSFYYGGKTYYNPSLKSRATISIDTSKSQFSLKLSSVTAADTAVYYCARGPTMIRGVIDSWGQGTLVTVSS

SEQ ID NO: 1499 - protein, 121 aa, Artificial Sequence
  Description of Artificial Sequence: Synthetic polypeptide
  TBRII-A[TGF-beta-RII]_H1.176
QLQVQESGPGLVKPSETLSLTCTVSGGSISNSYFYWGWIRQPPGKGLEWIGSFYYGGKTYYNPSLKSRATISIDTSKSQFSLKLSSVTAADTAVYYCARGPTMIRGVIDSWGQGTLVTVSS

SEQ ID NO: 1500 - protein, 121 aa, Artificial Sequence
  Description of Artificial Sequence: Synthetic polypeptide
  TBRII-A[TGF-beta-RII]_H1.177
QLQVQESGPGLVKPSETLSLTCTVSGGSISNSYFTWHWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1501 - protein, 121 aa, Artificial Sequence
  Description of Artificial Sequence: Synthetic polypeptide
  TBRII-A[TGF-beta-RII]_H1.178
QLQVQESGPGLVKPSETLSLTCTVSGGSISNSYFYWHWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 1502 - protein, 121 aa, Artificial Sequence
  Description of Artificial Sequence: Synthetic polypeptide
  TBRII-A[TGF-beta-RII]_H1.179
QLQVQESGPGLVKPSETLSLTCTVSGGSISNSYFTWHWIRQPPGKGLEWIGSFYYGGKTYYNPSLKSRATISIDTSKSQFSLKLSSVTAADTAVYYCPRGPTMIRGVIDSWGQGTLVTVSS

SEQ ID NO: 1503 - protein, 121 aa, Artificial Sequence
  Description of Artificial Sequence: Synthetic polypeptide
  TBRII-A[TGF-beta-RII]_H1.180
QLQVQESGPGLVKPSETLSLTCTVSGGSISNSYFYWHWIRQPPGKGLEWIGSFYYGGKTYYNPSLKSRATISIDTSKSQFSLKLSSVTAADTAVYYCPRGPTMIRGVIDSWGQGTLVTVSS

SEQ ID NO: 1504 - protein, 121 aa, Artificial Sequence
  Description of Artificial Sequence: Synthetic polypeptide
  TBRII-A[TGF-beta-RII]_H1.181
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1505 - protein, 121 aa, Artificial Sequence
  Description of Artificial Sequence: Synthetic polypeptide
  TBRII-A[TGF-beta-RII]_H1.182
QLQVQESGPGLVKPSETLSLTCTVSGGSISNSYFSWGWIRQPPGKGLEWIGSFYYGGKIYYNPSLKSRATISIDTSKNQFSLKLSSVTAADTAVYYCARGPTMIRGVIDSWGQGTLVTVSS

SEQ ID NO: 1506 - protein, 121 aa, Artificial Sequence
  Description of Artificial Sequence: Synthetic polypeptide
  TBRII-A[TGF-beta-RII]_H1.183
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTMIRGVFDSWGQGTLVTVSS

SEQ ID NO: 1507 - protein, 121 aa, Artificial Sequence
  Description of Artificial Sequence: Synthetic polypeptide
  TBRII-A[TGF-beta-RII]_H1.184
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1508 - protein, 121 aa, Artificial Sequence
  Description of Artificial Sequence: Synthetic polypeptide
  TBRII-A[TGF-beta-RII]_H1.185
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1509 - protein, 121 aa, Artificial Sequence
  Description of Artificial Sequence: Synthetic polypeptide
  TBRII-A[TGF-beta-RII]_H1.186
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1510 - protein, 121 aa, Artificial Sequence
  Description of Artificial Sequence: Synthetic polypeptide
  TBRII-A[TGF-beta-RII]_H1.187
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTVIRGVIDSWGQGTLVTVSS

SEQ ID NO: 1511 - protein, 121 aa, Artificial Sequence
  Description of Artificial Sequence: Synthetic polypeptide
  TBRII-A[TGF-beta-RII]_H1.188
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1512 - protein, 121 aa, Artificial Sequence
  Description of Artificial Sequence: Synthetic polypeptide
  TBRII-A[TGF-beta-RII]_H1.189
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1513 - protein, 121 aa, Artificial Sequence
  Description of Artificial Sequence: Synthetic polypeptide
  TBRII-A[TGF-beta-RII]_H1.190
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1514 - protein, 121 aa, Artificial Sequence
  Description of Artificial Sequence: Synthetic polypeptide
  TBRII-A[TGF-beta-RII]_H1.191
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTVIRGVIDSWGQGTLVTVSS

SEQ ID NO: 1515 - protein, 121 aa, Artificial Sequence
  Description of Artificial Sequence: Synthetic polypeptide
  TBRII-A[TGF-beta-RII]_H1.192
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1516 - protein, 121 aa, Artificial Sequence
  Description of Artificial Sequence: Synthetic polypeptide
  TBRII-A[TGF-beta-RII]_H1.193
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1517 - protein, 121 aa, Artificial Sequence
  Description of Artificial Sequence: Synthetic polypeptide
  TBRII-A[TGF-beta-RII]_H1.194
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1518 - protein, 121 aa, Artificial Sequence
  Description of Artificial Sequence: Synthetic polypeptide
  TBRII-A[TGF-beta-RII]_H1.195
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTVIRGVIDSWGQGTLVTVSS

SEQ ID NO: 1519 - protein, 121 aa, Artificial Sequence
  Description of Artificial Sequence: Synthetic polypeptide
  TBRII-A[TGF-beta-RII]_H1.196
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1520 - protein, 121 aa, Artificial Sequence
  Description of Artificial Sequence: Synthetic polypeptide
  TBRII-A[TGF-beta-RII]_H1.197
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1521 - protein, 121 aa, Artificial Sequence
  Description of Artificial Sequence: Synthetic polypeptide
  TBRII-A[TGF-beta-RII]_H1.198
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1522 - protein, 121 aa, Artificial Sequence
  Description of Artificial Sequence: Synthetic polypeptide
  TBRII-A[TGF-beta-RII]_H1.199
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTVIRGVIDSWGQGTLVTVSS

SEQ ID NO: 1523 - protein, 121 aa, Artificial Sequence
  Description of Artificial Sequence: Synthetic polypeptide
  TBRII-A[TGF-beta-RII]_H1.200
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1524 - protein, 121 aa, Artificial Sequence
  Description of Artificial Sequence: Synthetic polypeptide
  TBRII-A[TGF-beta-RII]_H1.201
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1525 - protein, 121 aa, Artificial Sequence
  Description of Artificial Sequence: Synthetic polypeptide
  TBRII-A[TGF-beta-RII]_H1.202
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1526 - protein, 121 aa, Artificial Sequence
  Description of Artificial Sequence: Synthetic polypeptide
  TBRII-A[TGF-beta-RII]_H1.203
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTVIRGVIDSWGQGTLVTVSS

SEQ ID NO: 1527 - protein, 121 aa, Artificial Sequence
  Description of Artificial Sequence: Synthetic polypeptide
  TBRII-A[TGF-beta-RII]_H1.204
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTAIRGVIDSWGQGTLVTVSS

SEQ ID NO: 1528 - protein, 121 aa, Artificial Sequence
  Description of Artificial Sequence: Synthetic polypeptide
  TBRII-A[TGF-beta-RII]_H1.205
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTIIRGVIDSWGQGTLVTVSS

SEQ ID NO: 1529 - protein, 121 aa, Artificial Sequence
  Description of Artificial Sequence: Synthetic polypeptide
  TBRII-A[TGF-beta-RII]_H1.206
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTSIRGVIDSWGQGTLVTVSS

SEQ ID NO: 1530 - protein, 121 aa, Artificial Sequence
  Description of Artificial Sequence: Synthetic polypeptide
  TBRII-A[TGF-beta-RII]_H1.207
QLQVQESGPGLVKPSETLSLTCTVSGGSISSSYFTWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1531 - protein, 121 aa, Artificial Sequence
  Description of Artificial Sequence: Synthetic polypeptide
  TBRII-A[TGF-beta-RII]_H1.208
QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1532 - protein, 121 aa, Artificial Sequence
  Description of Artificial Sequence: Synthetic polypeptide
  TBRII-A[TGF-beta-RII]_H1.209
QLQVQESGPGLVKPSETLSLTCTVSGGSISSSYFYWGWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1533 - protein, 121 aa, Artificial Sequence
  Description of Artificial Sequence: Synthetic polypeptide
  TBRII-A[TGF-beta-RII]_H1.210
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTLIRGVFDSWGQGTLVTVSS

SEQ ID NO: 1534 - protein, 121 aa, Artificial Sequence
  Description of Artificial Sequence: Synthetic polypeptide
  TBRII-A[TGF-beta-RII]_H1.211
QLQVQESGPGLVKPSETLSLTCTVSGGSISSSYFTWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1535 - protein, 121 aa, Artificial Sequence
  Description of Artificial Sequence: Synthetic polypeptide
  TBRII-A[TGF-beta-RII]_H1.212
QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1536 - protein, 121 aa, Artificial Sequence
  Description of Artificial Sequence: Synthetic polypeptide
  TBRII-A[TGF-beta-RII]_H1.213
QLQVQESGPGLVKPSETLSLTCTVSGGSISSSYFYWGWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1537 - protein, 121 aa, Artificial Sequence
  Description of Artificial Sequence: Synthetic polypeptide
  TBRII-A[TGF-beta-RII]_H1.214
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTTIRGVFDSWGQGTLVTVSS

SEQ ID NO: 1538 - protein, 121 aa, Artificial Sequence
  Description of Artificial Sequence: Synthetic polypeptide
  TBRII-A[TGF-beta-RII]_H1.215
QLQVQESGPGLVKPSETLSLTCTVSGGSISHSYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1539 - protein, 121 aa, Artificial Sequence
  Description of Artificial Sequence: Synthetic polypeptide
  TBRII-A[TGF-beta-RII]_H1.216
QLQVQESGPGLVKPSETLSLTCTVSGGSISNHYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1540 - protein, 121 aa, Artificial Sequence
  Description of Artificial Sequence: Synthetic polypeptide
  TBRII-A[TGF-beta-RII]_H1.217
QLQVQESGPGLVKPSETLSLTCTVSGGSISNSHFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1541 - protein, 121 aa, Artificial Sequence
  Description of Artificial Sequence: Synthetic polypeptide
  TBRII-A[TGF-beta-RII]_H1.218
QLQVQESGPGLVKPSETLSLTCTVSGGSISNSYFHWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1542 - protein, 121 aa, Artificial Sequence
  Description of Artificial Sequence: Synthetic polypeptide
  TBRII-A[TGF-beta-RII]_H1.219
QLQVQESGPGLVKPSETLSLTCTVSGGSISNSYFSWHWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1543 - protein, 121 aa, Artificial Sequence
  Description of Artificial Sequence: Synthetic polypeptide
  TBRII-A[TGF-beta-RII]_H1.220
QLQVQESGPGLVKPSETLSLTCTVSGGSISNSYFSWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1544 - protein, 121 aa, Artificial Sequence
  Description of Artificial Sequence: Synthetic polypeptide
  TBRII-A[TGF-beta-RII]_H1.221
QLQVQESGPGLVKPSETLSLTCTVSGGSISNSYFSWGWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1545 - protein, 121 aa, Artificial Sequence
  Description of Artificial Sequence: Synthetic polypeptide
  TBRII-A[TGF-beta-RII]_H1.222
QLQVQESGPGLVKPSETLSLTCTVSGGSISNSYFSWGWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1546 - protein, 121 aa, Artificial Sequence
  Description of Artificial Sequence: Synthetic polypeptide
  TBRII-A[TGF-beta-RII]_H1.223
QLQVQESGPGLVKPSETLSLTCTVSGGSISNSYFSWGWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1547 - protein, 121 aa, Artificial Sequence
  Description of Artificial Sequence: Synthetic polypeptide
  TBRII-A[TGF-beta-RII]_H1.224
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1548 - protein, 121 aa, Artificial Sequence
  Description of Artificial Sequence: Synthetic polypeptide
  TBRII-A[TGF-beta-RII]_H1.225
QLQVQESGPGLVKPSETLSLTCTVSGGSISHHYFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1549 - protein, 121 aa, Artificial Sequence
  Description of Artificial Sequence: Synthetic polypeptide
  TBRII-A[TGF-beta-RII]_H1.226
QLQVQESGPGLVKPSETLSLTCTVSGGSISHSHFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1550 - protein, 121 aa, Artificial Sequence
  Description of Artificial Sequence: Synthetic polypeptide
  TBRII-A[TGF-beta-RII]_H1.227
QLQVQESGPGLVKPSETLSLTCTVSGGSISHSYFHWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1551 - protein, 121 aa, Artificial Sequence
  Description of Artificial Sequence: Synthetic polypeptide
  TBRII-A[TGF-beta-RII]_H1.228
QLQVQESGPGLVKPSETLSLTCTVSGGSISHSYFSWHWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1552 - protein, 121 aa, Artificial Sequence
  Description of Artificial Sequence: Synthetic polypeptide
  TBRII-A[TGF-beta-RII]_H1.229
QLQVQESGPGLVKPSETLSLTCTVSGGSISHSYFSWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1553 - protein, 121 aa, Artificial Sequence
  Description of Artificial Sequence: Synthetic polypeptide
  TBRII-A[TGF-beta-RII]_H1.230
QLQVQESGPGLVKPSETLSLTCTVSGGSISHSYFSWGWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1554 - protein, 121 aa, Artificial Sequence
  Description of Artificial Sequence: Synthetic polypeptide
  TBRII-A[TGF-beta-RII]_H1.231
QLQVQESGPGLVKPSETLSLTCTVSGGSISHSYFSWGWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1555 - protein, 121 aa, Artificial Sequence
  Description of Artificial Sequence: Synthetic polypeptide
  TBRII-A[TGF-beta-RII]_H1.232
QLQVQESGPGLVKPSETLSLTCTVSGGSISHSYFSWGWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1556 - protein, 121 aa, Artificial Sequence
  Description of Artificial Sequence: Synthetic polypeptide
  TBRII-A[TGF-beta-RII]_H1.233
QLQVQESGPGLVKPSETLSLTCTVSGGSISHSYFSWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1557 - protein, 121 aa, Artificial Sequence
  Description of Artificial Sequence: Synthetic polypeptide
  TBRII-A[TGF-beta-RII]_H1.234
QLQVQESGPGLVKPSETLSLTCTVSGGSISNHHFSWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1558 - protein, 121 aa, Artificial Sequence
  Description of Artificial Sequence: Synthetic polypeptide
  TBRII-A[TGF-beta-RII]_H1.235
QLQVQESGPGLVKPSETLSLTCTVSGGSISNHYFHWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1559 - protein, 121 aa, Artificial Sequence
  Description of Artificial Sequence: Synthetic polypeptide
  TBRII-A[TGF-beta-RII]_H1.236
QLQVQESGPGLVKPSETLSLTCTVSGGSISNHYFSWHWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1560 - protein, 121 aa, Artificial Sequence
  Description of Artificial Sequence: Synthetic polypeptide
  TBRII-A[TGF-beta-RII]_H1.237
QLQVQESGPGLVKPSETLSLTCTVSGGSISNHYFSWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1561 - protein, 121 aa, Artificial Sequence
  Description of Artificial Sequence: Synthetic polypeptide
  TBRII-A[TGF-beta-RII]_H1.238
QLQVQESGPGLVKPSETLSLTCTVSGGSISNHYFSWGWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1562 - protein, 121 aa, Artificial Sequence
  Description of Artificial Sequence: Synthetic polypeptide
  TBRII-A[TGF-beta-RII]_H1.239
QLQVQESGPGLVKPSETLSLTCTVSGGSISNHYFSWGWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1563 - protein, 121 aa, Artificial Sequence
  Description of Artificial Sequence: Synthetic polypeptide
  TBRII-A[TGF-beta-RII]_H1.240
QLQVQESGPGLVKPSETLSLTCTVSGGSISNHYFSWGWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1564 - protein, 121 aa, Artificial Sequence
  Description of Artificial Sequence: Synthetic polypeptide
  TBRII-A[TGF-beta-RII]_H1.241
QLQVQESGPGLVKPSETLSLTCTVSGGSISNHYFSWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1565 - protein, 121 aa, Artificial Sequence
  Description of Artificial Sequence: Synthetic polypeptide
  TBRII-A[TGF-beta-RII]_H1.242
QLQVQESGPGLVKPSETLSLTCTVSGGSISNSHFHWGWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1566 - protein, 121 aa, Artificial Sequence
  Description of Artificial Sequence: Synthetic polypeptide
  TBRII-A[TGF-beta-RII]_H1.243
QLQVQESGPGLVKPSETLSLTCTVSGGSISNSHFSWHWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1567 - protein, 121 aa, Artificial Sequence
  Description of Artificial Sequence: Synthetic polypeptide
  TBRII-A[TGF-beta-RII]_H1.244
QLQVQESGPGLVKPSETLSLTCTVSGGSISNSHFSWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1568 - protein, 121 aa, Artificial Sequence
  Description of Artificial Sequence: Synthetic polypeptide
  TBRII-A[TGF-beta-RII]_H1.245
QLQVQESGPGLVKPSETLSLTCTVSGGSISNSHFSWGWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1569 - protein, 121 aa, Artificial Sequence
  Description of Artificial Sequence: Synthetic polypeptide
  TBRII-A[TGF-beta-RII]_H1.246
QLQVQESGPGLVKPSETLSLTCTVSGGSISNSHFSWGWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1570 - protein, 121 aa, Artificial Sequence
  Description of Artificial Sequence: Synthetic polypeptide
  TBRII-A[TGF-beta-RII]_H1.247
QLQVQESGPGLVKPSETLSLTCTVSGGSISNSHFSWGWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1571 - protein, 121 aa, Artificial Sequence
  Description of Artificial Sequence: Synthetic polypeptide
  TBRII-A[TGF-beta-RII]_H1.248
QLQVQESGPGLVKPSETLSLTCTVSGGSISNSHFSWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1572 - protein, 121 aa, Artificial Sequence
  Description of Artificial Sequence: Synthetic polypeptide
  TBRII-A[TGF-beta-RII]_H1.249
QLQVQESGPGLVKPSETLSLTCTVSGGSISNSYFHWHWIRQPPGKGLEWIGSFYYGGKTYYNPSLKSRATISIDTSKNQFSLKLSSVTAADTAVYYCARGPTMIRGVIDSWGQGTLVTVSS

SEQ ID NO: 1573 - protein, 121 aa, Artificial Sequence
  Description of Artificial Sequence: Synthetic polypeptide
  TBRII-A[TGF-beta-RII]_H1.250
QLQVQESGPGLVKPSETLSLTCTVSGGSISNSYFHWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1574 - protein, 121 aa, Artificial Sequence
  Description of Artificial Sequence: Synthetic polypeptide
  TBRII-A[TGF-beta-RII]_H1.251
QLQVQESGPGLVKPSETLSLTCTVSGGSISNSYFHWGWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1575 - protein, 121 aa, Artificial Sequence
  Description of Artificial Sequence: Synthetic polypeptide
  TBRII-A[TGF-beta-RII]_H1.252
QLQVQESGPGLVKPSETLSLTCTVSGGSISNSYFHWGWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1576 - protein, 121 aa, Artificial Sequence
  Description of Artificial Sequence: Synthetic polypeptide
  TBRII-A[TGF-beta-RII]_H1.253
QLQVQESGPGLVKPSETLSLTCTVSGGSISNSYFHWGWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1577 - protein, 121 aa, Artificial Sequence
  Description of Artificial Sequence: Synthetic polypeptide
  TBRII-A[TGF-beta-RII]_H1.254
QLQVQESGPGLVKPSETLSLTCTVSGGSISNSYFHWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1578 - protein, 121 aa, Artificial Sequence
  Description of Artificial Sequence: Synthetic polypeptide
  TBRII-A[TGF-beta-RII]_H1.255
QLQVQESGPGLVKPSETLSLTCTVSGGSISNSYFSWHWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1579 - protein, 121 aa, Artificial Sequence
  Description of Artificial Sequence: Synthetic polypeptide
  TBRII-A[TGF-beta-RII]_H1.256
QLQVQESGPGLVKPSETLSLTCTVSGGSISNSYFSWHWIRQPPGKGLEWIGSFYHGGKTYYNPSLKSRATISIDTSKNQFSLKLSSVTAADTAVYYCARGPTMIRGVIDSWGQGTLVTVSS

SEQ ID NO: 1580 - protein, 121 aa, Artificial Sequence
  Description of Artificial Sequence: Synthetic polypeptide
  TBRII-A[TGF-beta-RII]_H1.257
QLQVQESGPGLVKPSETLSLTCTVSGGSISNSYFSWHWIRQPPGKGLEWIGSFYYGGKTYYNPSLKSRATISIDHSKNQFSLKLSSVTAADTAVYYCARGPTMIRGVIDSWGQGTLVTVSS

SEQ ID NO: 1581 - protein, 121 aa, Artificial Sequence
  Description of Artificial Sequence: Synthetic polypeptide
  TBRII-A[TGF-beta-RII]_H1.258
QLQVQESGPGLVKPSETLSLTCTVSGGSISNSYFSWHWIRQPPGKGLEWIGSFYYGGKTYYNPSLKSRATISIDTSKHQFSLKLSSVTAADTAVYYCARGPTMIRGVIDSWGQGTLVTVSS

SEQ ID NO: 1582 - protein, 121 aa, Artificial Sequence
  Description of Artificial Sequence: Synthetic polypeptide
  TBRII-A[TGF-beta-RII]_H1.259
QLQVQESGPGLVKPSETLSLTCTVSGGSISNSYFSWHWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1583 - protein, 121 aa, Artificial Sequence
  Description of Artificial Sequence: Synthetic polypeptide
  TBRII-A[TGF-beta-RII]_H1.260
QLQVQESGPGLVKPSETLSLTCTVSGGSISNSYFSWGWIRQPPGKGLEWIGSFHHGGKTYYNPSLKSRATISIDTSKNQFSLKLSSVTAADTAVYYCARGPTMIRGVIDSWGQGTLVTVSS

SEQ ID NO: 1584 - protein, 121 aa, Artificial Sequence
  Description of Artificial Sequence: Synthetic polypeptide
  TBRII-A[TGF-beta-RII]_H1.261
QLQVQESGPGLVKPSETLSLTCTVSGGSISNSYFSWGWIRQPPGKGLEWIGSFHYGGKTYYNPSLKSRATISIDHSKNQFSLKLSSVTAADTAVYYCARGPTMIRGVIDSWGQGTLVTVSS

SEQ ID NO: 1585 - protein, 121 aa, Artificial Sequence
  Description of Artificial Sequence: Synthetic polypeptide
  TBRII-A[TGF-beta-RII]_H1.262
QLQVQESGPGLVKPSETLSLTCTVSGGSISNSYFSWGWIRQPPGKGLEWIGSFHYGGKTYYNPSLKSRATISIDTSKHQFSLKLSSVTAADTAVYYCARGPTMIRGVIDSWGQGTLVTVSS

SEQ ID NO: 1586 - protein, 121 aa, Artificial Sequence
  Description of Artificial Sequence: Synthetic polypeptide
  TBRII-A[TGF-beta-RII]_H1.263
QLQVQESGPGLVKPSETLSLTCTVSGGSISNSYFSWGWIRQPPGKGLEWIGSFHYGGKTYYNPSLKSRATISIDTSKNQFSLKLSSVTAADTAVYYCARGPTHIRGVIDSWGQGTLVTVSS

SEQ ID NO: 1587 - protein, 121 aa, Artificial Sequence
  Description of Artificial Sequence: Synthetic polypeptide
  TBRII-A[TGF-beta-RII]_H1.264
QLQVQESGPGLVKPSETLSLTCTVSGGSISNSYFSWGWIRQPPGKGLEWIGSFYHGGKTYYNPSLKSRATISIDHSKNQFSLKLSSVTAADTAVYYCARGPTMIRGVIDSWGQGTLVTVSS

SEQ ID NO: 1588 - protein, 121 aa, Artificial Sequence
  Description of Artificial Sequence: Synthetic polypeptide
  TBRII-A[TGF-beta-RII]_H1.265
QLQVQESGPGLVKPSETLSLTCTVSGGSISNSYFSWGWIRQPPGKGLEWIGSFYHGGKTYYNPSLKSRATISIDTSKHQFSLKLSSVTAADTAVYYCARGPTMIRGVIDSWGQGTLVTVSS

SEQ ID NO: 1589 - protein, 121 aa, Artificial Sequence
  Description of Artificial Sequence: Synthetic polypeptide
  TBRII-A[TGF-beta-RII]_H1.266
QLQVQESGPGLVKPSETLSLTCTVSGGSISNSYFSWGWIRQPPGKGLEWIGSFYHGGKTYYNPSLKSRATISIDTSKNQFSLKLSSVTAADTAVYYCARGPTHIRGVIDSWGQGTLVTVSS

SEQ ID NO: 1590 - protein, 121 aa, Artificial Sequence
  Description of Artificial Sequence: Synthetic polypeptide
  TBRII-A[TGF-beta-RII]_H1.267
QLQVQESGPGLVKPSETLSLTCTVSGGSISNSYFSWGWIRQPPGKGLEWIGSFYYGGKTYYNPSLKSRATISIDHSKHQFSLKLSSVTAADTAVYYCARGPTMIRGVIDSWGQGTLVTVSS

SEQ ID NO: 1591 - protein, 121 aa, Artificial Sequence
  Description of Artificial Sequence: Synthetic polypeptide
  TBRII-A[TGF-beta-RII]_H1.268
QLQVQESGPGLVKPSETLSLTCTVSGGSISNSYFSWGWIRQPPGKGLEWIGSFYYGGKTYYNPSLKSRATISIDHSKNQFSLKLSSVTAADTAVYYCARGPTHIRGVIDSWGQGTLVTVSS

SEQ ID NO: 1592 - protein, 121 aa, Artificial Sequence
  Description of Artificial Sequence: Synthetic polypeptide
  TBRII-A[TGF-beta-RII]_H1.269
QLQVQESGPGLVKPSETLSLTCTVSGGSISNSYFSWGWIRQPPGKGLEWIGSFYYGGKTYYNPSLKSRATISIDTSKHQFSLKLSSVTAADTAVYYCARGPTHIRGVIDSWGQGTLVTVSS

SEQ ID NO: 1593 - protein, 121 aa, Artificial Sequence
  Description of Artificial Sequence: Synthetic polypeptide
  TBRII-A[TGF-beta-RII]_H1.270
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTLIRGVIDSWGQGTLVTVSS

SEQ ID NO: 1594 - protein, 121 aa, Artificial Sequence
  Description of Artificial Sequence: Synthetic polypeptide
  TBRII-A[TGF-beta-RII]_H1.271
QLQVQESGPGLVKPSETLSLTCTVSGGSISSSYFSWHWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1595 - protein, 121 aa, Artificial Sequence
  Description of Artificial Sequence: Synthetic polypeptide
  TBRII-A[TGF-beta-RII]_H1.272
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTTIRGVIDSWGQGTLVTVSS

SEQ ID NO: 1596 - protein, 121 aa, Artificial Sequence
  Description of Artificial Sequence: Synthetic polypeptide
  TBRII-A[TGF-beta-RII]_H1.273
QLQVQESGPGLVKPSETLSLTCTVSGGSISSSYFSWHWIRQPPGKGLEWIGSFYYGGKTYYNPSLKSRATISIDTSKNQFSLKLSSVTAADTAVYYCARGPTTIRGVIDSWGQGTLVTVSS

SEQ ID NO: 1597 - protein, 121 aa, Artificial Sequence
  Description of Artificial Sequence: Synthetic polypeptide
  TBRII-A[TGF-beta-RII]_H1.274
QLQVQESGPGLVKPSETLSLTCTVSGGSISNAYFSWGWIRQPPGKGLEWIGSFNYGGKTYYNPSLKSRATISIDTSKNQFSLKLSSVTAADTAVYYCARGPTLIRGVIDSWGQGTLVTVSS

SEQ ID NO: 1598 - protein, 121 aa, Artificial Sequence
  Description of Artificial Sequence: Synthetic polypeptide
  TBRII-A[TGF-beta-RII]_H1.275
QLQVQESGPGLVKPSETLSLTCTVSGGSISNAYFSWHWIRQPPGKGLEWIGSFYYGGKTYYNPSLKSRATISIDTSKNQFSLKLSSVTAADTAVYYCARGPTLIRGVIDSWGQGTLVTVSS

SEQ ID NO: 1599 - protein, 121 aa, Artificial Sequence
  Description of Artificial Sequence: Synthetic polypeptide
  TBRII-A[TGF-beta-RII]_H1.276
QLQVQESGPGLVKPSETLSLTCTVSGGSISNHHFSWGWIRQPPGKGLEWIGSFHYGGKTYYNPSLKSRATISIDTSKNQFSLKLSSVTAADTAVYYCARGPTHIRGVIDSWGQGTLVTVSS

SEQ ID NO: 1600 - protein, 121 aa, Artificial Sequence
  Description of Artificial Sequence: Synthetic polypeptide
  TBRII-A[TGF-beta-RII]_H1.277
QLQVQESGPGLVKPSETLSLTCTVSGGSISNHHFSWGWIRQPPGKGLEWIGSFYYGGKTYYNPSLKSRATISIDTSKNQFSLKLSSVTAADTAVYYCARGPTHIRGVIDSWGQGTLVTVSS

SEQ ID NO: 1601 - protein, 121 aa, Artificial Sequence
  Description of Artificial Sequence: Synthetic polypeptide
  TBRII-A[TGF-beta-RII]_H1.278
QLQVQESGPGLVKPSETLSLTCTVSGGSISNHHFSWGWIRQPPGKGLEWIGSFHYGGKTYYNPSLKSRATISIDTSKNQFSLKLSSVTAADTAVYYCARGPTMIRGVIDSWGQGTLVTVSS

SEQ ID NO: 1602 - protein, 121 aa, Artificial Sequence
  Description of Artificial Sequence: Synthetic polypeptide
  TBRII-A[TGF-beta-RII]_H1.279
QLQVQESGPGLVKPSETLSLTCTVSGGSISNHYFSWGWIRQPPGKGLEWIGSFHYGGKTYYNPSLKSRATISIDTSKNQFSLKLSSVTAADTAVYYCARGPTHIRGVIDSWGQGTLVTVSS

SEQ ID NO: 1603 - protein, 121 aa, Artificial Sequence
  Description of Artificial Sequence: Synthetic polypeptide
  TBRII-A[TGF-beta-RII]_H1.280
QLQVQESGPGLVKPSETLSLTCTVSGGSISHSYFSWSWIRQPPGKGLEWIGSFYYGGKTYYNPSLKSRATISIDHSKHQFSLKLSSVTAADTAVYYCARGPTTIRGVIDSWGQGTLVTVSS

SEQ ID NO: 1604 - protein, 121 aa, Artificial Sequence
  Description of Artificial Sequence: Synthetic polypeptide
  TBRII-A[TGF-beta-RII]_H1.281
QLQVQESGPGLVKPSETLSLTCTVSGGSISSSYFSWSWIRQPPGKGLEWIGSFYYGGKTYYNPSLKSRATISIDHSKHQFSLKLSSVTAADTAVYYCARGPTTIRGVIDSWGQGTLVTVSS

SEQ ID NO: 1605 - protein, 121 aa, Artificial Sequence
  Description of Artificial Sequence: Synthetic polypeptide
  TBRII-A[TGF-beta-RII]_H1.282
QLQVQESGPGLVKPSETLSLTCTVSGGSISSSYFSWSWIRQPPGKGLEWIGSFYYGGKTYYNPSLKSRATISIDTSKHQFSLKLSSVTAADTAVYYCARGPTTIRGVIDSWGQGTLVTVSS

SEQ ID NO: 1606 - protein, 107 aa, Artificial Sequence; identical to SEQ ID NO: 529
  Description of Artificial Sequence: Synthetic polypeptide
  TBRII-A[TGF-beta-RII]_L1

SEQ ID NO: 1607 - protein, 107 aa, Artificial Sequence
  Description of Artificial Sequence: Synthetic polypeptide
  TBRII-A[TGF-beta-RII]_L1.1
EIVMTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1608 - protein, 107 aa, Artificial Sequence
  Description of Artificial Sequence: Synthetic polypeptide
  TBRII-A[TGF-beta-RII]_L1.2
EIVLTQSPGTLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1609 - protein, 107 aa, Artificial Sequence
  Description of Artificial Sequence: Synthetic polypeptide
  TBRII-A[TGF-beta-RII]_L1.3
EIVLTQSPPTLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1610 - protein, 107 aa, Artificial Sequence
  Description of Artificial Sequence: Synthetic polypeptide
  TBRII-A[TGF-beta-RII]_L1.4
EIVLTQSPATLSVSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1611 - protein, 107 aa, Artificial Sequence
  Description of Artificial Sequence: Synthetic polypeptide
  TBRII-A[TGF-beta-RII]_L1.5
EIVLTQSPATLSLSPGERVTLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1612 - protein, 107 aa, Artificial Sequence
  Description of Artificial Sequence: Synthetic polypeptide
  TBRII-A[TGF-beta-RII]_L1.6
EIVLTQSPATLSLSPGERATLSCGASQSVRSYLAWYQQKPGQAPRLLIYDASNRATGIPARFSGSGSGTDFTLTISSLEPEDFAVYYCQQRSNWPPTFGQGTKVEIK

SEQ ID NO: 1613 - protein, 107 aa, Artificial Sequence
  Description of Artificial Sequence: Synthetic polypeptide
  TBRII-A[TGF-beta-RII]_L1.7
EIVLTQSPATLSLSPGERATLSCRASQGVRSYLAWYQQKPGQAPRLLIYDASNRATGIPARFSGSGSGTDFTLTISSLEPEDFAVYYCQQRSNWPPTFGQGTKVEIK

SEQ ID NO: 1614 - protein, 107 aa, Artificial Sequence
  Description of Artificial Sequence: Synthetic polypeptide
  TBRII-A[TGF-beta-RII]_L1.8
EIVLTQSPATLSLSPGERATLSCRASQSVKSYLAWYQQKPGQAPRLLIYDASNRATGIPARFSGSGSGTDFTLTISSLEPEDFAVYYCQQRSNWPPTFGQGTKVEIK

SEQ ID NO: 1615 - protein, 107 aa, Artificial Sequence
  Description of Artificial Sequence: Synthetic polypeptide
  TBRII-A[TGF-beta-RII]_L1.9
EIVLTQSPATLSLSPGERATLSCRASQSVQSYLAWYQQKPGQAPRLLIYDASNRATGIPARFSGSGSGTDFTLTISSLEPEDFAVYYCQQRSNWPPTFGQGTKVEIK

SEQ ID NO: 1616 - protein, 107 aa, Artificial Sequence [sequence omitted]

SEQ ID NO: 1617 - protein, 107 aa, Artificial Sequence
  Description of Artificial Sequence: Synthetic polypeptide
  TBRII-A[TGF-beta-RII]_L1.11
EIVLTQSPATLSLSPGERATLSCRASQSVRNYLAWYQQKPGQAPRLLIYDASNRATGIPARFSGSGSGTDFTLTISSLEPEDFAVYYCQQRSNWPPTFGQGTKVEIK

SEQ ID NO: 1618 - protein, 107 aa, Artificial Sequence
  Description of Artificial Sequence: Synthetic polypeptide
  TBRII-A[TGF-beta-RII]_L1.12
EIVLTQSPATLSLSPGERATLSCRASQSVRTYLAWYQQKPGQAPRLLIYDASNRATGIPARFSGSGSGTDFTLTISSLEPEDFAVYYCQQRSNWPPTFGQGTKVEIK

SEQ ID NO: 1619 - protein, 107 aa, Artificial Sequence
  Description of Artificial Sequence: Synthetic polypeptide
  TBRII-A[TGF-beta-RII]_L1.13
EIVLTQSPATLSLSPGERATLSCRASQSVRSHLAWYQQKPGQAPRLLIYDASNRATGIPARFSGSGSGTDFTLTISSLEPEDFAVYYCQQRSNWPPTFGQGTKVEIK

SEQ ID NO: 1620 - protein, 107 aa, Artificial Sequence
  Description of Artificial Sequence: Synthetic polypeptide
  TBRII-A[TGF-beta-RII]_L1.14
EIVLTQSPATLSLSPGERATLSCRASQSVRSNLAWYQQKPGQAPRLLIYDASNRATGIPARFSGSGSGTDFTLTISSLEPEDFAVYYCQQRSNWPPTFGQGTKVEIK

SEQ ID NO: 1621 - protein, 107 aa, Artificial Sequence
  Description of Artificial Sequence: Synthetic polypeptide
  TBRII-A[TGF-beta-RII]_L1.15
EIVLTQSPATLSLSPGERATLSCRASQSVRSYLNWYQQKPGQAPRLLIYDASNRATGIPARFSGSGSGTDFTLTISSLEPEDFAVYYCQQRSNWPPTFGQGTKVEIK

SEQ ID NO: 1622 - protein, 107 aa, Artificial Sequence
  Description of Artificial Sequence: Synthetic polypeptide
  TBRII-A[TGF-beta-RII]_L1.16
EIVLTQSPATLSLSPGERATLSCRASQSVRSYLSWYQQKPGQAPRLLIYDASNRATGIPARFSGSGSGTDFTLTISSLEPEDFAVYYCQQRSNWPPTFGQGTKVEIK

SEQ ID NO: 1623 - protein, 107 aa, Artificial Sequence
  Description of Artificial Sequence: Synthetic polypeptide
  TBRII-A[TGF-beta-RII]_L1.17
EIVLTQSPATLSLSPGERATLSCRASQSVRSYLTWYQQKPGQAPRLLIYDASNRATGIPARFSGSGSGTDFTLTISSLEPEDFAVYYCQQRSNWPPTFGQGTKVEIK

SEQ ID NO: 1624 - protein, 107 aa, Artificial Sequence
  Description of Artificial Sequence: Synthetic polypeptide
  TBRII-A[TGF-beta-RII]_L1.18
EIVLTQSPATLSLSPGERATLSCRASQSVRSYLAWYQQKPGKAPRLLIYDASNRATGIPARFSGSGSGTDFTLTISSLEPEDFAVYYCQQRSNWPPTFGQGTKVEIK

SEQ ID NO: 1625 - protein, 107 aa, Artificial Sequence
  Description of Artificial Sequence: Synthetic polypeptide
  TBRII-A[TGF-beta-RII]_L1.19
EIVLTQSPATLSLSPGERATLSCRASQSVRSYLAWYQQKPGLAPRLLIYDASNRATGIPARFSGSGSGTDFTLTISSLEPEDFAVYYCQQRSNWPPTFGQGTKVEIK

SEQ ID NO: 1626 - protein, 107 aa, Artificial Sequence
  Description of Artificial Sequence: Synthetic polypeptide
  TBRII-A[TGF-beta-RII]_L1.20
EIVLTQSPATLSLSPGERATLSCRASQSVRSYLAWYQQKPGQAPRLLIYEASNRATGIPARFSGSGSGTDFTLTISSLEPEDFAVYYCQQRSNWPPTFGQGTKVEIK

SEQ ID NO: 1627 - protein, 107 aa, Artificial Sequence
  Description of Artificial Sequence: Synthetic polypeptide
  TBRII-A[TGF-beta-RII]_L1.21
EIVLTQSPATLSLSPGERATLSCRASQSVRSYLAWYQQKPGQAPRLLIYGASNRATGIPARFSGSGSGTDFTLTISSLEPEDFAVYYCQQRSNWPPTFGQGTKVEIK

SEQ ID NO: 1628 - protein, 107 aa, Artificial Sequence
  Description of Artificial Sequence: Synthetic polypeptide
  TBRII-A[TGF-beta-RII]_L1.22
EIVLTQSPATLSLSPGERATLSCRASQSVRSYLAWYQQKPGQAPRLLIYSASNRATGIPARFSGSGSGTDFTLTISSLEPEDFAVYYCQQRSNWPPTFGQGTKVEIK

SEQ ID NO: 1629 - protein, 107 aa, Artificial Sequence
  Description of Artificial Sequence: Synthetic polypeptide
  TBRII-A[TGF-beta-RII]_L1.23
EIVLTQSPATLSLSPGERATLSCRASQSVRSYLAWYQQKPGQAPRLLIYDASDRATGIPARFSGSGSGTDFTLTISSLEPEDFAVYYCQQRSNWPPTFGQGTKVEIK

SEQ ID NO: 1630 - protein, 107 aa, Artificial Sequence
  Description of Artificial Sequence: Synthetic polypeptide
  TBRII-A[TGF-beta-RII]_L1.24
EIVLTQSPATLSLSPGERATLSCRASQSVRSYLAWYQQKPGQAPRLLIYDASSRATGIPARFSGSGSGTDFTLTISSLEPEDFAVYYCQQRSNWPPTFGQGTKVEIK

SEQ ID NO: 1631 - protein, 107 aa, Artificial Sequence
  Description of Artificial Sequence: Synthetic polypeptide
  TBRII-A[TGF-beta-RII]_L1.25
EIVLTQSPATLSLSPGERATLSCRASQSVRSYLAWYQQKPGQAPRLLIYDASTRATGIPARFSGSGSGTDFTLTISSLEPEDFAVYYCQQRSNWPPTFGQGTKVEIK

SEQ ID NO: 1632 - protein, 107 aa, Artificial Sequence
  Description of Artificial Sequence: Synthetic polypeptide
  TBRII-A[TGF-beta-RII]_L1.26
EIVLTQSPATLSLSPGERATLSCRASQSVRSYLAWYQQKPGQAPRLLIYDASNRASGIPARFSGSGSGTDFTLTISSLEPEDFAVYYCQQRSNWPPTFGQGTKVEIK

SEQ ID NO: 1633 - protein, 107 aa, Artificial Sequence
  Description of Artificial Sequence: Synthetic polypeptide
  TBRII-A[TGF-beta-RII]_L1.27
EIVLTQSPATLSLSPGERATLSCRASQSVRSYLAWYQQKPGQAPRLLIYDASNRATSIPARFSGSGSGTDFTLTISSLEPEDFAVYYCQQRSNWPPTFGQGTKVEIK

SEQ ID NO: 1634 - protein, 107 aa, Artificial Sequence
  Description of Artificial Sequence: Synthetic polypeptide
  TBRII-A[TGF-beta-RII]_L1.28
EIVLTQSPATLSLSPGERATLSCRASQSVRSYLAWYQQKPGQAPRLLIYDASNRATGVPARFSGSGSGTDFTLTISSLEPEDFAVYYCQQRSNWPPTFGQGTKVEIK

SEQ ID NO: 1635 - protein, 107 aa, Artificial Sequence
  Description of Artificial Sequence: Synthetic polypeptide
  TBRII-A[TGF-beta-RII]_L1.29
EIVLTQSPATLSLSPGERATLSCRASQSVRSYLAWYQQKPGQAPRLLIYDASNRATGIPDRFSGSGSGTDFTLTISSLEPEDFAVYYCQQRSNWPPTFGQGTKVEIK

SEQ ID NO: 1636 - protein, 107 aa, Artificial Sequence
  Description of Artificial Sequence: Synthetic polypeptide
  TBRII-A[TGF-beta-RII]_L1.30
EIVLTQSPATLSLSPGERATLSCRASQSVRSYLAWYQQKPGQAPRLLIYDASNRATGIPARFSGSGSGTEFTLTISSLEPEDFAVYYCQQRSNWPPTFGQGTKVEIK

SEQ ID NO: 1637 - protein, 107 aa, Artificial Sequence
  Description of Artificial Sequence: Synthetic polypeptide
  TBRII-A[TGF-beta-RII]_L1.31
EIVLTQSPATLSLSPGERATLSCRASQSVRSYLAWYQQKPGQAPRLLIYDASNRATGIPARFSGSGSGTDFTLTISRLEPEDFAVYYCQQRSNWPPTFGQGTKVEIK

SEQ ID NO: 1638 - protein, 107 aa, Artificial Sequence
  Description of Artificial Sequence: Synthetic polypeptide
  TBRII-A[TGF-beta-RII]_L1.32
EIVLTQSPATLSLSPGERATLSCRASQSVRSYLAWYQQKPGQAPRLLIYDASNRATGIPARFSGSGSGTDFTLTISSLQPEDFAVYYCQQRSNWPPTFGQGTKVEIK

SEQ ID NO: 1639 - protein, 107 aa, Artificial Sequence
  Description of Artificial Sequence: Synthetic polypeptide
  TBRII-A[TGF-beta-RII]_L1.33
EIVLTQSPATLSLSPGERATLSCRASQSVRSYLAWYQQKPGQAPRLLIYDASNRATGIPARFSGSGSGTDFTLTISSLESEDFAVYYCQQRSNWPPTFGQGTKVEIK

SEQ ID NO: 1640 - protein, 107 aa, Artificial Sequence
  Description of Artificial Sequence: Synthetic polypeptide
  TBRII-A[TGF-beta-RII]_L1.34
EIVLTQSPATLSLSPGERATLSCRASQSVRSYLAWYQQKPGQAPRLLIYDASNRATGIPARFSGSGSGTDFTLTISSLQSEDFAVYYCQQRSNWPPTFGQGTKVEIK

SEQ ID NO: 1641 - protein, 107 aa, Artificial Sequence
  Description of Artificial Sequence: Synthetic polypeptide
  TBRII-A[TGF-beta-RII]_L1.35
EIVLTQSPATLSLSPGERATLSCRASQSVRSYLAWYQQKPGQAPRLLIYDASNRATGIPARFSGSGSGTDFTLTISSLEPEDFATYYCQQRSNWPPTFGQGTKVEIK

SEQ ID NO: 1642 - protein, 107 aa, Artificial Sequence
  Description of Artificial Sequence: Synthetic polypeptide
  TBRII-A[TGF-beta-RII]_L1.36
EIVLTQSPATLSLSPGERATLSCRASQSVRSYLAWYQQKPGQAPRLLIYDASNRATGIPARFSGSGSGTDFTLTISSLEPEDFAVYYCQQESNWPPTFGQGTKVEIK

SEQ ID NO: 1643 - protein, 107 aa, Artificial Sequence
  Description of Artificial Sequence: Synthetic polypeptide
  TBRII-A[TGF-beta-RII]_L1.37
EIVLTQSPATLSLSPGERATLSCRASQSVRSYLAWYQQKPGQAPRLLIYDASNRATGIPARFSGSGSGTDFTLTISSLEPEDFAVYYCQQKSNWPPTFGQGTKVEIK

SEQ ID NO: 1644 - protein, 107 aa, Artificial Sequence
  Description of Artificial Sequence: Synthetic polypeptide
  TBRII-A[TGF-beta-RII]_L1.38
EIVLTQSPATLSLSPGERATLSCRASQSVRSYLAWYQQKPGQAPRLLIYDASNRATGIPARFSGSGSGTDFTLTISSLEPEDFAVYYCQQSSNWPPTFGQGTKVEIK

SEQ ID NO: 1645 - protein, 107 aa, Artificial Sequence
  Description of Artificial Sequence: Synthetic polypeptide
  TBRII-A[TGF-beta-RII]_L1.39
EIVLTQSPATLSLSPGERATLSCRASQSVRSYLAWYQQKPGQAPRLLIYDASNRATGIPARFSGSGSGTDFTLTISSLEPEDFAVYYCQQQSNWPPTFGQGTKVEIK

SEQ ID NO: 1646 - protein, 107 aa, Artificial Sequence
  Description of Artificial Sequence: Synthetic polypeptide
  TBRII-A[TGF-beta-RII]_L1.40
EIVLTQSPATLSLSPGERATLSCRASQSVRSYLAWYQQKPGQAPRLLIYDASNRATGIPARFSGSGSGTDFTLTISSLEPEDFAVYYCQQYSNWPPTFGQGTKVEIK

SEQ ID NO: 1647 - protein, 107 aa, Artificial Sequence
  Description of Artificial Sequence: Synthetic polypeptide
  TBRII-A[TGF-beta-RII]_L1.41
EIVLTQSPATLSLSPGERATLSCRASQSVRSYLAWYQQKPGQAPRLLIYDASNRATGIPARFSGSGSGTDFTLTISSLEPEDFAVYYCQQRANWPPTFGQGTKVEIK

SEQ ID NO: 1648 - protein, 107 aa, Artificial Sequence
  Description of Artificial Sequence: Synthetic polypeptide
  TBRII-A[TGF-beta-RII]_L1.42
EIVLTQSPATLSLSPGERATLSCRASQSVRSYLAWYQQKPGQAPRLLIYDASNRATGIPARFSGSGSGTDFTLTISSLEPEDFAVYYCQQRGNWPPTFGQGTKVEIK

SEQ ID NO: 1649 - protein, 107 aa, Artificial Sequence
  Description of Artificial Sequence: Synthetic polypeptide
  TBRII-A[TGF-beta-RII]_L1.43
EIVLTQSPATLSLSPGERATLSCRASQSVRSYLAWYQQKPGQAPRLLIYDASNRATGIPARFSGSGSGTDFTLTISSLEPEDFAVYYCQQRNNWPPTFGQGTKVEIK

SEQ ID NO: 1650 - protein, 107 aa, Artificial Sequence
  Description of Artificial Sequence: Synthetic polypeptide
  TBRII-A[TGF-beta-RII]_L1.44
EIVLTQSPATLSLSPGERATLSCRASQSVRSYLAWYQQKPGQAPRLLIYDASNRATGIPARFSGSGSGTDFTLTISSLEPEDFAVYYCQQRTNWPPTFGQGTKVEIK

SEQ ID NO: 1651 - protein, 107 aa, Artificial Sequence
  Description of Artificial Sequence: Synthetic polypeptide
  TBRII-A[TGF-beta-RII]_L1.45
EIVLTQSPATLSLSPGERATLSCRASQSVRSYLAWYQQKPGQAPRLLIYDASNRATGIPARFSGSGSGTDFTLTISSLEPEDFAVYYCQQRSDWPPTFGQGTKVEIK

SEQ ID NO: 1652 - protein, 107 aa, Artificial Sequence
  Description of Artificial Sequence: Synthetic polypeptide
  TBRII-A[TGF-beta-RII]_L1.46
EIVLTQSPATLSLSPGERATLSCRASQSVRSYLAWYQQKPGQAPRLLIYDASNRATGIPARFSGSGSGTDFTLTISSLEPEDFAVYYCQQRSSWPPTFGQGTKVEIK

SEQ ID NO: 1653 - protein, 107 aa, Artificial Sequence
  Description of Artificial Sequence: Synthetic polypeptide
  TBRII-A[TGF-beta-RII]_L1.47
EIVLTQSPATLSLSPGERATLSCRASQSVRSYLAWYQQKPGQAPRLLIYDASNRATGIPARFSGSGSGTDFTLTISSLEPEDFAVYYCQQRSQWPPTFGQGTKVEIK

SEQ ID NO: 1654 - protein, 107 aa, Artificial Sequence
  Description of Artificial Sequence: Synthetic polypeptide
  TBRII-A[TGF-beta-RII]_L1.48
EIVLTQSPATLSLSPGERATLSCRASQSVRSYLAWYQQKPGQAPRLLIYDASNRATGIPARFSGSGSGTDFTLTISSLEPEDFAVYYCQQRSNHPPTFGQGTKVEIK

SEQ ID NO: 1655 - protein, 107 aa, Artificial Sequence
  Description of Artificial Sequence: Synthetic polypeptide
  TBRII-A[TGF-beta-RII]_L1.49
EIVLTQSPATLSLSPGERATLSCRASQSVRSYLAWYQQKPGQAPRLLIYDASNRATGIPARFSGSGSGTDFTLTISSLEPEDFAVYYCQQRSNVPPTFGQGTKVEIK

SEQ ID NO: 1656 - protein, 107 aa, Artificial Sequence
  Description of Artificial Sequence: Synthetic polypeptide
  TBRII-A[TGF-beta-RII]_L1.50
EIVLTQSPATLSLSPGERATLSCRASQSVRSYLAWYQQKPGQAPRLLIYDASNRATGIPARFSGSGSGTDFTLTISSLEPEDFAVYYCQQRSNIPPTFGQGTKVEIK

SEQ ID NO: 1657 - protein, 107 aa, Artificial Sequence
  Description of Artificial Sequence: Synthetic polypeptide
  TBRII-A[TGF-beta-RII]_L1.51
EIVLTQSPATLSLSPGERATLSCRASQSVRSYLAWYQQKPGQAPRLLIYDASNRATGIPARFSGSGSGTDFTLTISSLEPEDFAVYYCQQRSNLPPTFGQGTKVEIK

SEQ ID NO: 1658 - protein, 107 aa, Artificial Sequence
  Description of Artificial Sequence: Synthetic polypeptide
  TBRII-A[TGF-beta-RII]_L1.52
EIVLTQSPATLSLSPGERATLSCRASQSVRSYLAWYQQKPGQAPRLLIYDASNRATGIPARFSGSGSGTDFTLTISSLEPEDFAVYYCQQRSNSPPTFGQGTKVEIK

SEQ ID NO: 1659 - protein, 107 aa, Artificial Sequence
  Description of Artificial Sequence: Synthetic polypeptide
  TBRII-A[TGF-beta-RII]_L1.53
EIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIK

SEQ ID NO: 1660 - protein, 107 aa, Artificial Sequence
  Description of Artificial Sequence: Synthetic polypeptide
  TBRII-A[TGF-beta-RII]_L1.54
EIVLTQSPATLSLSPGERATLSCRASQSVRSYLAWYQQKPGQAPRLLIYDASNRATGIPARFSGSGSGTDFTLTISSLEPEDFAVYYCQQRSNWPFTFGQGTKVEIK

SEQ ID NO: 1661 - protein, 107 aa, Artificial Sequence
  Description of Artificial Sequence: Synthetic polypeptide
  TBRII-A[TGF-beta-RII]_L1.55
EIVLTQSPATLSLSPGERATLSCRASQSVRSYLAWYQQKPGQAPRLLIYDASNRATGIPARFSGSGSGTDFTLTISSLEPEDFAVYYCQQRSNWPITFGQGTKVEIK

SEQ ID NO: 1662 - protein, 107 aa, Artificial Sequence
  Description of Artificial Sequence: Synthetic polypeptide
  TBRII-A[TGF-beta-RII]_L1.56
EIVLTQSPATLSLSPGERATLSCRASQSVRSYLAWYQQKPGQAPRLLIYDASNRATGIPARFSGSGSGTDFTLTISSLEPEDFAVYYCQQRSNWPLTFGQGTKVEIK

SEQ ID NO: 1663 - protein, 107 aa, Artificial Sequence
  Description of Artificial Sequence: Synthetic polypeptide
  TBRII-A[TGF-beta-RII]_L1.57
EIVLTQSPATLSLSPGERATLSCRASQSVRSYLAWYQQKPGQAPRLLIYDASNRATGIPARFSGSGSGTDFTLTISSLEPEDFAVYYCQQRSNWPWTFGQGTKVEIK

SEQ ID NO: 1664 - protein, 107 aa, Artificial Sequence
  Description of Artificial Sequence: Synthetic polypeptide
  TBRII-A[TGF-beta-RII]_L1.58
EIVLTQSPATLSLSPGERATLSCRASQSVRSYLAWYQQKPGQAPRLLIYDASNRATGIPARFSGSGSGTDFTLTISSLEPEDFAVYYCQQRSNWPYTFGQGTKVEIK

SEQ ID NO: 1665 - protein, 107 aa, Artificial Sequence
  Description of Artificial Sequence: Synthetic polypeptide
  TBRII-A[TGF-beta-RII]_L1.59
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGGGTKVEIK

SEQ ID NO: 1666 - protein, 107 aa, Artificial Sequence
  Description of Artificial Sequence: Synthetic polypeptide
  TBRII-A[TGF-beta-RII]_L1.60
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGPGTKVEIK

SEQ ID NO: 1667 - protein, 107 aa, Artificial Sequence
  Description of Artificial Sequence: Synthetic polypeptide
  TBRII-A[TGF-beta-RII]_L1.61
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKLEIK

SEQ ID NO: 1668 - protein, 107 aa, Artificial Sequence
  Description of Artificial Sequence: Synthetic polypeptide
  TBRII-A[TGF-beta-RII]_L1.62
EIVLTQSPATLSVSPGERATLSCRASQSVRTYLAWYQQKPGQAPRLLIYDASNRATGIPARFSGSGSGTDFTLTISSLQPEDFAVYYCQQRANWPPTFGQGTKVEIK

SEQ ID NO: 1669 - protein, 107 aa, Artificial Sequence
  Description of Artificial Sequence: Synthetic polypeptide
  TBRII-A[TGF-beta-RII]_L1.63
EIVLTQSPATLSVSPGERATLSCRASQSVRTYLAWYQQKPGQAPRLLIYDASNRATGIPARFSGSGSGTDFTLTISSLQPEDFAVYYCQQRSSWPPTFGQGTKVEIK

SEQ ID NO: 1670 - protein, 107 aa, Artificial Sequence
  Description of Artificial Sequence: Synthetic polypeptide
  TBRII-A[TGF-beta-RII]_L1.64
EIVLTQSPATLSVSPGERATLSCRASQSVRTYLAWYQQKPGQAPRLLIYDASNRATGIPARFSGSGSGTDFTLTISSLQPEDFAVYYCQQRSNWPPTFGPGTKVEIK

SEQ ID NO: 1671 - protein, 107 aa, Artificial Sequence
  Description of Artificial Sequence: Synthetic polypeptide
  TBRII-A[TGF-beta-RII]_L1.65
EIVLTQSPATLSVSPGERATLSCRASQSVRTYLAWYQQKPGQAPRLLIYDASNRATGIPARFSGSGSGTDFTLTISSLEPEDFAVYYCQQRASWPPTFGQGTKVEIK

SEQ ID NO: 1672 - protein, 107 aa, Artificial Sequence
  Description of Artificial Sequence: Synthetic polypeptide
  TBRII-A[TGF-beta-RII]_L1.66
EIVLTQSPATLSVSPGERATLSCRASQSVRTYLAWYQQKPGQAPRLLIYDASNRATGIPARFSGSGSGTDFTLTISSLEPEDFAVYYCQQRANWPPTFGPGTKVEIK

SEQ ID NO: 1673 - protein, 107 aa, Artificial Sequence
  Description of Artificial Sequence: Synthetic polypeptide
  TBRII-A[TGF-beta-RII]_L1.67
EIVLTQSPATLSVSPGERATLSCRASQSVRTYLAWYQQKPGQAPRLLIYDASNRATGIPARFSGSGSGTDFTLTISSLEPEDFAVYYCQQRSSWPPTFGPGTKVEIK

SEQ ID NO: 1674 - protein, 107 aa, Artificial Sequence
  Description of Artificial Sequence: Synthetic polypeptide
  TBRII-A[TGF-beta-RII]_L1.68
EIVLTQSPATLSVSPGERATLSCRASQSVRSYLAWYQQKPGQAPRLLIYDASNRATGIPARFSGSGSGTDFTLTISSLQPEDFAVYYCQQRASWPPTFGQGTKVEIK

SEQ ID NO: 1675 - protein, 107 aa, Artificial Sequence
  Description of Artificial Sequence: Synthetic polypeptide
  TBRII-A[TGF-beta-RII]_L1.69
EIVLTQSPATLSVSPGERATLSCRASQSVRSYLAWYQQKPGQAPRLLIYDASNRATGIPARFSGSGSGTDFTLTISSLQPEDFAVYYCQQRANWPPTFGPGTKVEIK

SEQ ID NO: 1676 - protein, 107 aa, Artificial Sequence
  Description of Artificial Sequence: Synthetic polypeptide
  TBRII-A[TGF-beta-RII]_L1.70
EIVLTQSPATLSVSPGERATLSCRASQSVRSYLAWYQQKPGQAPRLLIYDASNRATGIPARFSGSGSGTDFTLTISSLQPEDFAVYYCQQRSSWPPTFGPGTKVEIK

SEQ ID NO: 1677 - protein, 107 aa, Artificial Sequence
  Description of Artificial Sequence: Synthetic polypeptide
  TBRII-A[TGF-beta-RII]_L1.71
EIVLTQSPATLSVSPGERATLSCRASQSVRSYLAWYQQKPGQAPRLLIYDASNRATGIPARFSGSGSGTDFTLTISSLEPEDFAVYYCQQRASWPPTFGPGTKVEIK

SEQ ID NO: 1678 - protein, 107 aa, Artificial Sequence
  Description of Artificial Sequence: Synthetic polypeptide
  TBRII-A[TGF-beta-RII]_L1.72
EIVLTQSPATLSLSPGERATLSCRASQSVRTYLAWYQQKPGQAPRLLIYDASNRATGIPARFSGSGSGTDFTLTISSLQPEDFAVYYCQQRASWPPTFGQGTKVEIK

SEQ ID NO: 1679 - protein, 107 aa, Artificial Sequence
  Description of Artificial Sequence: Synthetic polypeptide
  TBRII-A[TGF-beta-RII]_L1.73
EIVLTQSPATLSLSPGERATLSCRASQSVRTYLAWYQQKPGQAPRLLIYDASNRATGIPARFSGSGSGTDFTLTISSLQPEDFAVYYCQQRANWPPTFGPGTKVEIK

SEQ ID NO: 1680 - protein, 107 aa, Artificial Sequence
  Description of Artificial Sequence: Synthetic polypeptide
  TBRII-A[TGF-beta-RII]_L1.74
EIVLTQSPATLSLSPGERATLSCRASQSVRTYLAWYQQKPGQAPRLLIYDASNRATGIPARFSGSGSGTDFTLTISSLQPEDFAVYYCQQRSSWPPTFGPGTKVEIK

SEQ ID NO: 1681 - protein, 107 aa, Artificial Sequence
  Description of Artificial Sequence: Synthetic polypeptide
  TBRII-A[TGF-beta-RII]_L1.75
EIVLTQSPATLSLSPGERATLSCRASQSVRTYLAWYQQKPGQAPRLLIYDASNRATGIPARFSGSGSGTDFTLTISSLEPEDFAVYYCQQRASWPPTFGPGTKVEIK

SEQ ID NO: 1682 - protein, 107 aa, Artificial Sequence
  Description of Artificial Sequence: Synthetic polypeptide
  TBRII-A[TGF-beta-RII]_L1.76
EIVLTQSPATLSLSPGERATLSCRASQSVRSYLAWYQQKPGQAPRLLIYDASNRATGIPARFSGSGSGTDFTLTISSLQPEDFAVYYCQQRASWPPTFGPGTKVEIK

SEQ ID NO: 1683 - protein, 107 aa, Artificial Sequence
  Description of Artificial Sequence: Synthetic polypeptide
  TBRII-A[TGF-beta-RII]_L1.77
EIVLTQSPATLSVSPGERATLSCRASQSVRTYLAWYQQKPGQAPRLLIYDASNRATGIPARFSGSGSGTDFTLTISSLQPEDFAVYYCQQRASWPPTFGQGTKVEIK

SEQ ID NO: 1684 - protein, 107 aa, Artificial Sequence
  Description of Artificial Sequence: Synthetic polypeptide
  TBRII-A[TGF-beta-RII]_L1.78
EIVLTQSPATLSVSPGERATLSCRASQSVRTYLAWYQQKPGQAPRLLIYDASNRATGIPARFSGSGSGTDFTLTISSLQPEDFAVYYCQQRANWPPTFGPGTKVEIK

SEQ ID NO: 1685 - protein, 107 aa, Artificial Sequence
  Description of Artificial Sequence: Synthetic polypeptide
  TBRII-A[TGF-beta-RII]_L1.79
EIVLTQSPATLSVSPGERATLSCRASQSVRTYLAWYQQKPGQAPRLLIYDASNRATGIPARFSGSGSGTDFTLTISSLQPEDFAVYYCQQRSSWPPTFGPGTKVEIK

SEQ ID NO: 1686 - protein, 107 aa, Artificial Sequence
  Description of Artificial Sequence: Synthetic polypeptide
  TBRII-A[TGF-beta-RII]_L1.80
EIVLTQSPATLSVSPGERATLSCRASQSVRTYLAWYQQKPGQAPRLLIYDASNRATGIPARFSGSGSGTDFTLTISSLEPEDFAVYYCQQRASWPPTFGPGTKVEIK

SEQ ID NO: 1687 - protein, 107 aa, Artificial Sequence
  Description of Artificial Sequence: Synthetic polypeptide
  TBRII-A[TGF-beta-RII]_L1.81
EIVLTQSPATLSVSPGERATLSCRASQSVRSYLAWYQQKPGQAPRLLIYDASNRATGIPARFSGSGSGTDFTLTISSLQPEDFAVYYCQQRASWPPTFGPGTKVEIK

SEQ ID NO: 1688 - protein, 107 aa, Artificial Sequence
  Description of Artificial Sequence: Synthetic polypeptide
  TBRII-A[TGF-beta-RII]_L1.82
EIVLTQSPATLSLSPGERATLSCRASQSVRTYLAWYQQKPGQAPRLLIYDASNRATGIPARFSGSGSGTDFTLTISSLQPEDFAVYYCQQRASWPPTFGPGTKVEIK

SEQ ID NO: 1689 - protein, 107 aa, Artificial Sequence
  Description of Artificial Sequence: Synthetic polypeptide
  TBRII-A[TGF-beta-RII]_L1.83
EIVLTQSPATLSVSPGERATLSCRASQSVRTYLAWYQQKPGQAPRLLIYDASNRATGIPARFSGSGSGTDFTLTISSLQPEDFAVYYCQQRASWPPTFGPGTKVEIK

SEQ ID NO: 1690 - protein, 107 aa, Artificial Sequence
  Description of Artificial Sequence: Synthetic polypeptide
  TBRII-A[TGF-beta-RII]_L1.84
EIVLTQSPATLSLSPGERATLSCRASQSVRSYLAWYQQKPGQAPRLLIYDASDRATGIPARFSGSGSGTDFTLTISSLEPEDFAVYYCQQRSQWPPTFGQGTKVEIK

SEQ ID NO: 1691 - protein, 107 aa, Artificial Sequence
  Description of Artificial Sequence: Synthetic polypeptide
  TBRII-A[TGF-beta-RII]_L1.85
EIVLTQSPATLSLSPGERATLSCRASQSVRSYLAWYQQKPGQAPRLLIYDASDRATGIPARFSGSGSGTDFTLTISSLEPEDFAVYYCQQRSNYPPTFGQGTKVEIK

SEQ ID NO: 1692 - protein, 107 aa, Artificial Sequence
  Description of Artificial Sequence: Synthetic polypeptide
  TBRII-A[TGF-beta-RII]_L1.86
EIVLTQSPATLSLSPGERATLSCRASQSVRSYLAWYQQKPGQAPRLLIYDASNRATGIPARFSGSGSGTDFTLTISSLEPEDFAVYYCQQRSQYPPTFGQGTKVEIK

SEQ ID NO: 1693 - protein, 107 aa, Artificial Sequence
  Description of Artificial Sequence: Synthetic polypeptide
  TBRII-A[TGF-beta-RII]_L1.87
EIVLTQSPATLSLSPGERATLSCRASQSVRSYLAWYQQKPGQAPRLLIYDASDRATGIPARFSGSGSGTDFTLTISSLEPEDFAVYYCQQRSQYPPTFGQGTKVEIK

SEQ ID NO: 1694 - protein, 107 aa, Artificial Sequence
  Description of Artificial Sequence: Synthetic polypeptide
  TBRII-A[TGF-beta-RII]_L1.88
EIVLTQSPATLSLSPGERATLSCRASQSVRSYLAWYQQKPGQAPRLLIYDASHRATGIPARFSGSGSGTDFTLTISSLEPEDFAVYYCQQRSNWPPTFGQGTKVEIK

SEQ ID NO: 1695 - protein, 107 aa, Artificial Sequence
  Description of Artificial Sequence: Synthetic polypeptide
  TBRII-A[TGF-beta-RII]_L1.89
EIVLTQSPATLSLSPGERATLSCRASQSVRSYLAWYQQKPGQAPRLLIYDASNRATGIPARFSGSGSGTDFTLTISSLEPEDFAVYYCQQRHNWPPTFGQGTKVEIK

SEQ ID NO: 1696 - protein, 107 aa, Artificial Sequence
  Description of Artificial Sequence: Synthetic polypeptide
  TBRII-A[TGF-beta-RII]_L1.90
EIVLTQSPATLSLSPGERATLSCRASQSVRSYLAWYQQKPGQAPRLLIYDASNRATGIPARFSGSGSGTDFTLTISSLEPEDFAVYYCQQRSHWPPTFGQGTKVEIK

SEQ ID NO: 1697 - protein, 107 aa, Artificial Sequence
  Description of Artificial Sequence: Synthetic polypeptide
  TBRII-A[TGF-beta-RII]_L1.91
EIVLTQSPATLSLSPGERATLSCRASQSVRSHLAWYQQKPGQAPRLLIYDASHRATGIPARFSGSGSGTDFTLTISSLEPEDFAVYYCQQRSNWPPTFGQGTKVEIK

SEQ ID NO: 1698 - protein, 107 aa, Artificial Sequence
  Description of Artificial Sequence: Synthetic polypeptide
  TBRII-A[TGF-beta-RII]_L1.92
EIVLTQSPATLSLSPGERATLSCRASQSVRSHLAWYQQKPGQAPRLLIYDASNRATGIPARFSGSGSGTDFTLTISSLEPEDFAVYYCQQRHNWPPTFGQGTKVEIK

SEQ ID NO: 1699 - protein, 107 aa, Artificial Sequence
  Description of Artificial Sequence: Synthetic polypeptide
  TBRII-A[TGF-beta-RII]_L1.93
EIVLTQSPATLSLSPGERATLSCRASQSVRSHLAWYQQKPGQAPRLLIYDASNRATGIPARFSGSGSGTDFTLTISSLEPEDFAVYYCQQRSHWPPTFGQGTKVEIK

SEQ ID NO: 1700 - protein, 107 aa, Artificial Sequence
  Description of Artificial Sequence: Synthetic polypeptide
  TBRII-A[TGF-beta-RII]_L1.94
EIVLTQSPATLSLSPGERATLSCRASQSVRSYLAWYQQKPGQAPRLLIYDASHRATGIPARFSGSGSGTDFTLTISSLEPEDFAVYYCQQRHNWPPTFGQGTKVEIK

SEQ ID NO: 1701 - protein, 107 aa, Artificial Sequence
  Description of Artificial Sequence: Synthetic polypeptide
  TBRII-A[TGF-beta-RII]_L1.95
EIVLTQSPATLSLSPGERATLSCRASQSVRSYLAWYQQKPGQAPRLLIYDASHRATGIPARFSGSGSGTDFTLTISSLEPEDFAVYYCQQRSHWPPTFGQGTKVEIK

SEQ ID NO: 1702 - protein, 107 aa, Artificial Sequence
  Description of Artificial Sequence: Synthetic polypeptide
  TBRII-A[TGF-beta-RII]_L1.96
EIVLTQSPATLSLSPGERATLSCRASQSVRSYLAWYQQKPGQAPRLLIYDASNRATGIPARFSGSGSGTDFTLTISSLEPEDFAVYYCQQRHHWPPTFGQGTKVEIK

SEQ ID NO: 1703 - protein, 107 aa, Artificial Sequence
  Description of Artificial Sequence: Synthetic polypeptide
  TBRII-A[TGF-beta-RII]_L1.97
EIVLTQSPATLSLSPGERATLSCRASQSVRSHLAWYQQKPGQAPRLLIYDASHRATGIPARFSGSGSGTDFTLTISSLEPEDFAVYYCQQRHNWPPTFGQGTKVEIK

SEQ ID NO: 1704 - protein, 119 aa, Artificial Sequence
  Description of Artificial Sequence: Synthetic polypeptide
  Cd5-B[CD5]_H0
QVTLKESGAELVRPGASVKLSCKASGYSFTSYWMNWVKQRPGQGLEWIGMIHPSDSETRLNQKFKDKATLTVDKSSSTAYMQLSSPTSEDSAVYYCARWGDHDDAMDFWGQGTMVTVSS

SEQ ID NO: 1705 - protein, 119 aa, Artificial Sequence
  Description of Artificial Sequence: Synthetic polypeptide
  Cd5-B[CD5]_H1
EVQLVQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1706 - protein, 119 aa, Artificial Sequence
  Description of Artificial Sequence: Synthetic polypeptide
  Cd5-B[CD5]_H1.1
QVQLVQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1707 - protein, 119 aa, Artificial Sequence
  Description of Artificial Sequence: Synthetic polypeptide
  Cd5-B[CD5]_H1.2
EVTLVQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1708 - protein, 119 aa, Artificial Sequence
  Description of Artificial Sequence: Synthetic polypeptide
  Cd5-B[CD5]_H1.3
EVQLKQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1709 - protein, 119 aa, Artificial Sequence
  Description of Artificial Sequence: Synthetic polypeptide
  Cd5-B[CD5]_H1.4
EVQLVESGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1710 - protein, 119 aa, Artificial Sequence
  Description of Artificial Sequence: Synthetic polypeptide
  Cd5-B[CD5]_H1.5
EVQLVQSGAELKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1711 - protein, 119 aa, Artificial Sequence
  Description of Artificial Sequence: Synthetic polypeptide
  Cd5-B[CD5]_H1.6
EVQLVQSGAEVVKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1712 - protein, 119 aa, Artificial Sequence
  Description of Artificial Sequence: Synthetic polypeptide
  Cd5-B[CD5]_H1.7
EVQLVQSGAEVKRPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1713 - protein, 119 aa, Artificial Sequence
  Description of Artificial Sequence: Synthetic polypeptide
  Cd5-B[CD5]_H1.8
EVQLVQSGAEVKKPGESVKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1714 - protein, 119 aa, Artificial Sequence
  Description of Artificial Sequence: Synthetic polypeptide
  Cd5-B[CD5]_H1.9
EVQLVQSGAEVKKPGESLKISCKASGYSFTSYWINWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1715 - protein, 119 aa, Artificial Sequence
  Description of Artificial Sequence: Synthetic polypeptide
  Cd5-B[CD5]_H1.10
EVQLVQSGAEVKKPGESLKISCKASGYSFTSYWLNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1716 - protein, 119 aa, Artificial Sequence
  Description of Artificial Sequence: Synthetic polypeptide
  Cd5-B[CD5]_H1.11
EVQLVQSGAEVKKPGESLKISCKASGYSFTSYWVNWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1717 - protein, 119 aa, Artificial Sequence
  Description of Artificial Sequence: Synthetic polypeptide
  Cd5-B[CD5]_H1.12
EVQLVQSGAEVKKPGESLKISCKASGYSFTSYWMGWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1718 - protein, 119 aa, Artificial Sequence
  Description of Artificial Sequence: Synthetic polypeptide
  Cd5-B[CD5]_H1.13
EVQLVQSGAEVKKPGESLKISCKASGYSFTSYWMQWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1719 - protein, 119 aa, Artificial Sequence
  Description of Artificial Sequence: Synthetic polypeptide
  Cd5-B[CD5]_H1.14
EVQLVQSGAEVKKPGESLKISCKASGYSFTSYWMDWVRQMPGKGLEWMGMIHPSDSETRYNQSFQGQVTISVDKSISTAYLQWSSLKASDTAMYYCARWGDHDDAMDFWGQGTMVTVSS

SEQ ID NO: 1720 - protein, 119 aa, Artificial Sequence
  Description of Artificial Sequence: Synthetic polypeptide
  Cd5-B[CD5]_H1.15
EVQLVQSGAEVKKPGESLKISCKASGYSFTSYWMNWVKQMPGKGLEWMGMIHPSDSETRYNQSFQGQVTISVDKSISTAYLQWSSLKASDTAMYYCARWGDHDDAMDFWGQGTMVTVSS

SEQ ID NO: 1721 - protein, 119 aa, Artificial Sequence
  Description of Artificial Sequence: Synthetic polypeptide
  Cd5-B[CD5]_H1.16
EVQLVQSGAEVKKPGESLKISCKASGYSFTSYWMNWVRQAPGKGLEWMGMIHPSDSETRYNQSFQGQVTISVDKSISTAYLQWSSLKASDTAMYYCARWGDHDDAMDFWGQGTMVTVSS

SEQ ID NO: 1722 - protein, 119 aa, Artificial Sequence
  Description of Artificial Sequence: Synthetic polypeptide
  Cd5-B[CD5]_H1.17
EVQLVQSGAEVKKPGESLKISCKASGYSFTSYWMNWVRQRPGKGLEWMGMIHPSDSETRYNQSFQGQVTISVDKSISTAYLQWSSLKASDTAMYYCARWGDHDDAMDFWGQGTMVTVSS

SEQ ID NO: 1723 - protein, 119 aa, Artificial Sequence
  Description of Artificial Sequence: Synthetic polypeptide
  Cd5-B[CD5]_H1.18
EVQLVQSGAEVKKPGESLKISCKASGYSFTSYWMNWVRQMPGQGLEWMGMIHPSDSETRYNQSFQGQVTISVDKSISTAYLQWSSLKASDTAMYYCARWGDHDDAMDFWGQGTMVTVSS

SEQ ID NO: 1724 - protein, 119 aa, Artificial Sequence
  Description of Artificial Sequence: Synthetic polypeptide
  Cd5-B[CD5]_H1.19
EVQLVQSGAEVKKPGESLKISCKASGYSFTSYWMNWVRQMPGKGLEWIGMIHPSDSETRYNQSFQGQVTISVDKSISTAYLQWSSLKASDTAMYYCARWGDHDDAMDFWGQGTMVTVSS

SEQ ID NO: 1725 - protein, 119 aa, Artificial Sequence
  Description of Artificial Sequence: Synthetic polypeptide
  Cd5-B[CD5]_H1.20
EVQLVQSGAEVKKPGESLKISCKASGYSFTSYWMNWVRQMPGKGLEWMGIIHPSDSETRYNQSFQGQVTISVDKSISTAYLQWSSLKASDTAMYYCARWGDHDDAMDFWGQGTMVTVSS

SEQ ID NO: 1726 - protein, 119 aa, Artificial Sequence
  Description of Artificial Sequence: Synthetic polypeptide
  Cd5-B[CD5]_H1.21
EVQLVQSGAEVKKPGESLKISCKASGYSFTSYWMNWVRQMPGKGLEWMGLIHPSDSETRYNQSFQGQVTISVDKSISTAYLQWSSLKASDTAMYYCARWGDHDDAMDFWGQGTMVTVSS

SEQ ID NO: 1727 - protein, 119 aa, Artificial Sequence
  Description of Artificial Sequence: Synthetic polypeptide
  Cd5-B[CD5]_H1.22
EVQLVQSGAEVKKPGESLKISCKASGYSFTSYWMNWVRQMPGKGLEWMGVIHPSDSETRYNQSFQGQVTISVDKSISTAYLQWSSLKASDTAMYYCARWGDHDDAMDFWGQGTMVTVSS

SEQ ID NO: 1728 - protein, 119 aa, Artificial Sequence
  Description of Artificial Sequence: Synthetic polypeptide
  Cd5-B[CD5]_H1.23
EVQLVQSGAEVKKPGESLKISCKASGYSFTSYWMNWVRQMPGKGLEWMGMIYPSDSETRYNQSFQGQVTISVDKSISTAYLQWSSLKASDTAMYYCARWGDHDDAMDFWGQGTMVTVSS

SEQ ID NO: 1729 - protein, 119 aa, Artificial Sequence
  Description of Artificial Sequence: Synthetic polypeptide
  Cd5-B[CD5]_H1.24
EVQLVQSGAEVKKPGESLKISCKASGYSFTSYWMNWVRQMPGKGLEWMGMIFPSDSETRYNQSFQGQVTISVDKSISTAYLQWSSLKASDTAMYYCARWGDHDDAMDFWGQGTMVTVSS

SEQ ID NO: 1730 - protein, 119 aa, Artificial Sequence
  Description of Artificial Sequence: Synthetic polypeptide
  Cd5-B[CD5]_H1.25
EVQLVQSGAEVKKPGESLKISCKASGYSFTSYWMNWVRQMPGKGLEWMGMIWPSDSETRYNQSFQGQVTISVDKSISTAYLQWSSLKASDTAMYYCARWGDHDDAMDFWGQGTMVTVSS

SEQ ID NO: 1731 - protein, 119 aa, Artificial Sequence
  Description of Artificial Sequence: Synthetic polypeptide
  Cd5-B[CD5]_H1.26
EVQLVQSGAEVKKPGESLKISCKASGYSFTSYWMNWVRQMPGKGLEWMGMIHPGDSETRYNQSFQGQVTISVDKSISTAYLQWSSLKASDTAMYYCARWGDHDDAMDFWGQGTMVTVSS

SEQ ID NO: 1732 - protein, 119 aa, Artificial Sequence
  Description of Artificial Sequence: Synthetic polypeptide
  Cd5-B[CD5]_H1.27
EVQLVQSGAEVKKPGESLKISCKASGYSFTSYWMNWVRQMPGKGLEWMGMIHPTDSETRYNQSFQGQVTISVDKSISTAYLQWSSLKASDTAMYYCARWGDHDDAMDFWGQGTMVTVSS

SEQ ID NO: 1733 - protein, 119 aa, Artificial Sequence
  Description of Artificial Sequence: Synthetic polypeptide
  Cd5-B[CD5]_H1.28
EVQLVQSGAEVKKPGESLKISCKASGYSFTSYWMNWVRQMPGKGLEWMGMIHPADSETRYNQSFQGQVTISVDKSISTAYLQWSSLKASDTAMYYCARWGDHDDAMDFWGQGTMVTVSS

SEQ ID NO: 1734 - protein, 119 aa, Artificial Sequence
  Description of Artificial Sequence: Synthetic polypeptide
  Cd5-B[CD5]_H1.29
EVQLVQSGAEVKKPGESLKISCKASGYSFTSYWMNWVRQMPGKGLEWMGMIHPSDSDTRYNQSFQGQVTISVDKSISTAYLQWSSLKASDTAMYYCARWGDHDDAMDFWGQGTMVTVSS

SEQ ID NO: 1735 - protein, 119 aa, Artificial Sequence
  Description of Artificial Sequence: Synthetic polypeptide
  Cd5-B[CD5]_H1.30
EVQLVQSGAEVKKPGESLKISCKASGYSFTSYWMNWVRQMPGKGLEWMGMIHPSDSQTRYNQSFQGQVTISVDKSISTAYLQWSSLKASDTAMYYCARWGDHDDAMDFWGQGTMVTVSS

SEQ ID NO: 1736 - protein, 119 aa, Artificial Sequence
  Description of Artificial Sequence: Synthetic polypeptide
  Cd5-B[CD5]_H1.31
EVQLVQSGAEVKKPGESLKISCKASGYSFTSYWMNWVRQMPGKGLEWMGMIHPSDSNTRYNQSFQGQVTISVDKSISTAYLQWSSLKASDTAMYYCARWGDHDDAMDFWGQGTMVTVSS

SEQ ID NO: 1737 - protein, 119 aa, Artificial Sequence
  Description of Artificial Sequence: Synthetic polypeptide
  Cd5-B[CD5]_H1.32
EVQLVQSGAEVKKPGESLKISCKASGYSFTSYWMNWVRQMPGKGLEWMGMIHPSDSETRLNQSFQGQVTISVDKSISTAYLQWSSLKASDTAMYYCARWGDHDDAMDFWGQGTMVTVSS

SEQ ID NO: 1738 - protein, 119 aa, Artificial Sequence
  Description of Artificial Sequence: Synthetic polypeptide
  Cd5-B[CD5]_H1.33
EVQLVQSGAEVKKPGESLKISCKASGYSFTSYWMNWVRQMPGKGLEWMGMIHPSDSETRYSQSFQGQVTISVDKSISTAYLQWSSLKASDTAMYYCARWGDHDDAMDFWGQGTMVTVSS

SEQ ID NO: 1739 - protein, 119 aa, Artificial Sequence
  Description of Artificial Sequence: Synthetic polypeptide
  Cd5-B[CD5]_H1.34
EVQLVQSGAEVKKPGESLKISCKASGYSFTSYWMNWVRQMPGKGLEWMGMIHPSDSETRYTQSFQGQVTISVDKSISTAYLQWSSLKASDTAMYYCARWGDHDDAMDFWGQGTMVTVSS

SEQ ID NO: 1740 - protein, 119 aa, Artificial Sequence
  Description of Artificial Sequence: Synthetic polypeptide
  Cd5-B[CD5]_H1.35
EVQLVQSGAEVKKPGESLKISCKASGYSFTSYWMNWVRQMPGKGLEWMGMIHPSDSETRYNPSFQGQVTISVDKSISTAYLQWSSLKASDTAMYYCARWGDHDDAMDFWGQGTMVTVSS

SEQ ID NO: 1741 - protein, 119 aa, Artificial Sequence
  Description of Artificial Sequence: Synthetic polypeptide
  Cd5-B[CD5]_H1.36
EVQLVQSGAEVKKPGESLKISCKASGYSFTSYWMNWVRQMPGKGLEWMGMIHPSDSETRYNQKFQGQVTISVDKSISTAYLQWSSLKASDTAMYYCARWGDHDDAMDFWGQGTMVTVSS

SEQ ID NO: 1742 - protein, 119 aa, Artificial Sequence
  Description of Artificial Sequence: Synthetic polypeptide
  Cd5-B[CD5]_H1.37
EVQLVQSGAEVKKPGESLKISCKASGYSFTSYWMNWVRQMPGKGLEWMGMIHPSDSETRYNQSFKGQVTISVDKSISTAYLQWSSLKASDTAMYYCARWGDHDDAMDFWGQGTMVTVSS

SEQ ID NO: 1743 - protein, 119 aa, Artificial Sequence
  Description of Artificial Sequence: Synthetic polypeptide
  Cd5-B[CD5]_H1.38
EVQLVQSGAEVKKPGESLKISCKASGYSFTSYWMNWVRQMPGKGLEWMGMIHPSDSETRYNQSFQDQVTISVDKSISTAYLQWSSLKASDTAMYYCARWGDHDDAMDFWGQGTMVTVSS

SEQ ID NO: 1744 - protein, 119 aa, Artificial Sequence
  Description of Artificial Sequence: Synthetic polypeptide
  Cd5-B[CD5]_H1.39
EVQLVQSGAEVKKPGESLKISCKASGYSFTSYWMNWVRQMPGKGLEWMGMIHPSDSETRYNQSFQGKVTISVDKSISTAYLQWSSLKASDTAMYYCARWGDHDDAMDFWGQGTMVTVSS

SEQ ID NO: 1745 - protein, 119 aa, Artificial Sequence
  Description of Artificial Sequence: Synthetic polypeptide
  Cd5-B[CD5]_H1.40
EVQLVQSGAEVKKPGESLKISCKASGYSFTSYWMNWVRQMPGKGLEWMGMIHPSDSETRYNQSFQGQATISVDKSISTAYLQWSSLKASDTAMYYCARWGDHDDAMDFWGQGTMVTVSS

SEQ ID NO: 1746 - protein, 119 aa, Artificial Sequence
  Description of Artificial Sequence: Synthetic polypeptide
  Cd5-B[CD5]_H1.41
EVQLVQSGAEVKKPGESLKISCKASGYSFTSYWMNWVRQMPGKGLEWMGMIHPSDSETRYNQSFQGQVTLSVDKSISTAYLQWSSLKASDTAMYYCARWGDHDDAMDFWGQGTMVTVSS

SEQ ID NO: 1747 - protein, 119 aa, Artificial Sequence
  Description of Artificial Sequence: Synthetic polypeptide
  Cd5-B[CD5]_H1.42
EVQLVQSGAEVKKPGESLKISCKASGYSFTSYWMNWVRQMPGKGLEWMGMIHPSDSETRYNQSFQGQVTISVDKSISTAYLQLSSLKASDTAMYYCARWGDHDDAMDFWGQGTMVTVSS

SEQ ID NO: 1748 - protein, 119 aa, Artificial Sequence
  Description of Artificial Sequence: Synthetic polypeptide
  Cd5-B[CD5]_H1.43
EVQLVQSGAEVKKPGESLKISCKASGYSFTSYWMNWVRQMPGKGLEWMGMIHPSDSETRYNQSFQGQVTISVDKSISTAYLQWSSPKASDTAMYYCARWGDHDDAMDFWGQGTMVTVSS

SEQ ID NO: 1749 - protein, 119 aa, Artificial Sequence
  Description of Artificial Sequence: Synthetic polypeptide
  Cd5-B[CD5]_H1.44
EVQLVQSGAEVKKPGESLKISCKASGYSFTSYWMNWVRQMPGKGLEWMGMIHPSDSETRYNQSFQGQVTISVDKSISTAYLQWSSLTASDTAMYYCARWGDHDDAMDFWGQGTMVTVSS

SEQ ID NO: 1750 - protein, 119 aa, Artificial Sequence
  Description of Artificial Sequence: Synthetic polypeptide
  Cd5-B[CD5]_H1.45
EVQLVQSGAEVKKPGESLKISCKASGYSFTSYWMNWVRQMPGKGLEWMGMIHPSDSETRYNQSFQGQVTISVDKSISTAYLQWSSLRASDTAMYYCARWGDHDDAMDFWGQGTMVTVSS

SEQ ID NO: 1751 - protein, 119 aa, Artificial Sequence
  Description of Artificial Sequence: Synthetic polypeptide
  Cd5-B[CD5]_H1.46
EVQLVQSGAEVKKPGESLKISCKASGYSFTSYWMNWVRQMPGKGLEWMGMIHPSDSETRYNQSFQGQVTISVDKSISTAYLQWSSLKAEDTAMYYCARWGDHDDAMDFWGQGTMVTVSS

SEQ ID NO: 1752 - protein, 119 aa, Artificial Sequence
  Description of Artificial Sequence: Synthetic polypeptide
  Cd5-B[CD5]_H1.47
EVQLVQSGAEVKKPGESLKISCKASGYSFTSYWMNWVRQMPGKGLEWMGMIHPSDSETRYNQSFQGQVTISVDKSISTAYLQWSSLKASDSAMYYCARWGDHDDAMDFWGQGTMVTVSS

SEQ ID NO: 1753 - protein, 119 aa, Artificial Sequence
  Description of Artificial Sequence: Synthetic polypeptide
  Cd5-B[CD5]_H1.48
EVQLVQSGAEVKKPGESLKISCKASGYSFTSYWMNWVRQMPGKGLEWMGMIHPSDSETRYNQSFQGQVTISVDKSISTAYLQWSSLKASDTAVYYCARWGDHDDAMDFWGQGTMVTVSS

SEQ ID NO: 1754 - protein, 119 aa, Artificial Sequence
  Description of Artificial Sequence: Synthetic polypeptide
  Cd5-B[CD5]_H2
QVQLVQSGAEVKKPGASVKVSCKASGYSFTSYWMNWVRQAPGQGLEWMGMIHPSDSETRYNQKFQGRVTMTVDKSTSTAYMELSSLRSEDTAVYYCARWGDHDDAMDFWGQGTMVTVSS

SEQ ID NO: 1755 - protein, 107 aa, Artificial Sequence
  Description of Artificial Sequence: Synthetic polypeptide
  Cd5-B[CD5]_L0
DIVLTQSPASLSASVGESVTITCRPSENIYGYFAWYQQRQGKSPQLLVYNAKTLAEGVPSRFSGSGSGTHFSLKINSLQPEDFGTYYCQHHYGTPFTFGPGTKVDIK

SEQ ID NO: 1756 - protein, 107 aa, Artificial Sequence
  Description of Artificial Sequence: Synthetic polypeptide
  Cd5-B[CD5]_L1
DIVLTQSPSSLSASVGDRVTITCRPSENIYGYFAWYQQKPGKSPKLLVYNAKTLAEGVPSRFSGSGSGTDFTLTISSLQPEDFATYYCQHHYGTPFTFGPGTKVEIK

SEQ ID NO: 1757 - protein, 107 aa, Artificial Sequence
  Description of Artificial Sequence: Synthetic polypeptide
  Cd5-B[CD5]_L2
DIVLTQSPDSLAVSLGERATINCKPSENIYGYFAWYQQKPGQSPKLLVYNAKTLAEGVPSRFSGSGSGTDFTLTISSLQAEDVAVYYCQHHYGTPFTFGPGTKVEIK

SEQ ID NO: 1758 - protein, 15 aa, Artificial Sequence
  Description of Artificial Sequence: Synthetic peptide
GGGGSGGGGSGGGGS

SEQ ID NO: 1759 - protein, 18 aa, Artificial Sequence
  Description of Artificial Sequence: Synthetic peptide
GSTSGSGKPGSGEGSTKG

SEQ ID NO: 1760 - protein, 14 aa, Artificial Sequence
  Description of Artificial Sequence: Synthetic peptide
IRPRAIGGSKPRVA

SEQ ID NO: 1761 - protein, 15 aa, Artificial Sequence
  Description of Artificial Sequence: Synthetic peptide
GKGGSGKGGSGKGGS

SEQ ID NO: 1762 - protein, 15 aa, Artificial Sequence
  Description of Artificial Sequence: Synthetic peptide
GGKGSGGKGSGGKGS

SEQ ID NO: 1763 - protein, 15 aa, Artificial Sequence
  Description of Artificial Sequence: Synthetic peptide
GGGKSGGGKSGGGKS

SEQ ID NO: 1764 - protein, 15 aa, Artificial Sequence
  Description of Artificial Sequence: Synthetic peptide
GKGKSGKGKSGKGKS

SEQ ID NO: 1765 - protein, 15 aa, Artificial Sequence
  Description of Artificial Sequence: Synthetic peptide
GGGKSGGKGSGKGGS

SEQ ID NO: 1766 - protein, 15 aa, Artificial Sequence
  Description of Artificial Sequence: Synthetic peptide
GKPGSGKPGSGKPGS

SEQ ID NO: 1767 - protein, 20 aa, Artificial Sequence
  Description of Artificial Sequence: Synthetic peptide
GKPGSGKPGSGKPGSGKPGS

SEQ ID NO: 1768 - protein, 20 aa, Artificial Sequence
  Description of Artificial Sequence: Synthetic peptide
GKGKSGKGKSGKGKSGKGKS

SEQ ID NO: 1769 - protein, 20 aa, Artificial Sequence
  Description of Artificial Sequence: Synthetic peptide
GGGGSGGGGSGGGGSGGGGS

SEQ ID NO: 1770 - protein, 14 aa, Artificial Sequence
  Description of Artificial Sequence: Synthetic peptide
STAGDTHLGGEDFD

SEQ ID NO: 1771 - protein, 15 aa, Artificial Sequence
  Description of Artificial Sequence: Synthetic peptide
GEGGSGEGGSGEGGS

SEQ ID NO: 1772 - protein, 15 aa, Artificial Sequence
  Description of Artificial Sequence: Synthetic peptide
GGEGSGGEGSGGEGS

SEQ ID NO: 1773 - protein, 15 aa, Artificial Sequence
  Description of Artificial Sequence: Synthetic peptide
GGGESGGGESGGGES

SEQ ID NO: 1774 - protein, 15 aa, Artificial Sequence
  Description of Artificial Sequence: Synthetic peptide
GEGESGEGESGEGES

SEQ ID NO: 1775 - protein, 15 aa, Artificial Sequence
  Description of Artificial Sequence: Synthetic peptide
GGGESGGEGSGEGGS

SEQ ID NO: 1776 - protein, 20 aa, Artificial Sequence
  Description of Artificial Sequence: Synthetic peptide
GEGESGEGESGEGESGEGES

SEQ ID NO: 1777 - protein, 19 aa, Artificial Sequence
  Description of Artificial Sequence: Synthetic peptide
PRGASKSGSASQTGSAPGS

SEQ ID NO: 1778 - protein, 19 aa, Artificial Sequence
  Description of Artificial Sequence: Synthetic peptide
GTAAAGAGAAGGAAAGAAG

SEQ ID NO: 1779 - protein, 19 aa, Artificial Sequence
  Description of Artificial Sequence: Synthetic peptide
GTSGSSGSGSGGSGSGGGG

SEQ ID NO: 1780 - protein, 5 aa, Artificial Sequence
  Description of Artificial Sequence: Synthetic peptide
GGGGS

SEQ ID NO: 1781 - protein, 10 aa, Artificial Sequence
  Description of Artificial Sequence: Synthetic peptide
GGGGSGGGGS

SEQ ID NO: 1782 - protein, 25 aa, Artificial Sequence
  Description of Artificial Sequence: Synthetic peptide
GGGGSGGGGSGGGGSGGGGSGGGGS

SEQ ID NO: 1783 - protein, 30 aa, Artificial Sequence
  Description of Artificial Sequence: Synthetic polypeptide
GGGGSGGGGSGGGGSGGGGSGGGGSGGGGS

SEQ ID NO: 1784 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 1785 - protein, 5 aa, Artificial Sequence
  Description of Artificial Sequence: Synthetic peptide
GGGGA

SEQ ID NO: 1786 - protein, 10 aa, Artificial Sequence
  Description of Artificial Sequence: Synthetic peptide
GGGGAGGGGA

SEQ ID NO: 1787 - protein, 15 aa, Artificial Sequence
  Description of Artificial Sequence: Synthetic peptide
GGGGAGGGGAGGGGA

SEQ ID NO: 1788 - protein, 20 aa, Artificial Sequence
  Description of Artificial Sequence: Synthetic peptide
GGGGAGGGGAGGGGAGGGGA

SEQ ID NO: 1789 - protein, 25 aa, Artificial Sequence
  Description of Artificial Sequence: Synthetic peptide
GGGGAGGGGAGGGGAGGGGAGGGGA

SEQ ID NO: 1790 - protein, 30 aa, Artificial Sequence
  Description of Artificial Sequence: Synthetic polypeptide
GGGGAGGGGAGGGGAGGGGAGGGGAGGGGA

SEQ ID NO: 1791 - protein, 35 aa, Artificial Sequence
  Description of Artificial Sequence: Synthetic polypeptide
GGGGAGGGGAGGGGAGGGGAGGGGAGGGGAGGGGA

SEQ ID NO: 1792 - protein, 30 aa, Artificial Sequence
  Description of Artificial Sequence: Synthetic polypeptide
DPALVHQRPAPPGGGGSGGGGSGGGGSGGG

SEQ ID NO: 1793 - protein, 5 aa, Artificial Sequence
  Description of Artificial Sequence: Synthetic peptide
GKPGS

SEQ ID NO: 1794 - protein, 25 aa, Artificial Sequence
  Description of Artificial Sequence: Synthetic peptide
GKPGSGKPGSGKPGSGKPGSGKPGS

SEQ ID NO: 1795 - protein, 30 aa, Artificial Sequence
  Description of Artificial Sequence: Synthetic polypeptide
GKPGSGKPGSGKPGSGKPGSGKPGSGKPGS

SEQ ID NO: 1796 - protein, 5 aa, Artificial Sequence
  Description of Artificial Sequence: Synthetic peptide
GGGES

SEQ ID NO: 1797 - protein, 9 aa, Artificial Sequence
  Description of Artificial Sequence: Synthetic peptide
KTHTCPPCP

SEQ ID NO: 1798 - protein, 15 aa, Artificial Sequence
  Description of Artificial Sequence: Synthetic peptide
EPKSSDKTHTCPPCP

SEQ ID NO: 1799 - protein, 19 aa, Artificial Sequence
  Description of Artificial Sequence: Synthetic peptide
GGGGSGGGGSKTHTCPPCP

SEQ ID NO: 1800 - protein, 19 aa, Artificial Sequence
  Description of Artificial Sequence: Synthetic peptide
GKPGSGKPGSKTHTCPPCP

SEQ ID NO: 1801 - protein, 14 aa, Artificial Sequence
  Description of Artificial Sequence: Synthetic peptide
GKPGSKTHTCPPCP

SEQ ID NO: 1802 - protein, 5 aa, Artificial Sequence
  Description of Artificial Sequence: Synthetic peptide
EPKSC

SEQ ID NO: 1803 - protein, 15 aa, Artificial Sequence
  Description of Artificial Sequence: Synthetic peptide
EPKSCGGGGSGGGGS

SEQ ID NO: 1804 - protein, 15 aa, Artificial Sequence
  Description of Artificial Sequence: Synthetic peptide
EPKSCGKPGSGKPGS

SEQ ID NO: 1805 - protein, 10 aa, Artificial Sequence
  Description of Artificial Sequence: Synthetic peptide
EPKSCGKPGS

SEQ ID NO: 1806 - protein, 216 aa, Artificial Sequence
  Description of Artificial Sequence: Synthetic polypeptide
  Heterodimeric Fc Backbone 1 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1807 - protein, 216 aa, Artificial Sequence
  Description of Artificial Sequence: Synthetic polypeptide
  Heterodimeric Fc Backbone 1 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1808 - protein, 216 aa, Artificial Sequence; identical to SEQ ID NO: 1806
  Description of Artificial Sequence: Synthetic polypeptide
  Heterodimeric Fc Backbone 2 monomer 1 (-)

SEQ ID NO: 1809 - protein, 216 aa, Artificial Sequence
  Description of Artificial Sequence: Synthetic polypeptide
  Heterodimeric Fc Backbone monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1810 - protein, 216 aa, Artificial Sequence
  Description of Artificial Sequence: Synthetic polypeptide
  Heterodimeric Fc Backbone 3 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 1811 - protein, 216 aa, Artificial Sequence; identical to SEQ ID NO: 1809
  Description of Artificial Sequence: Synthetic polypeptide
  Heterodimeric Fc Backbone 3 monomer 2 (+)

SEQ ID NO: 1812 - protein, 216 aa, Artificial Sequence
  Description of Artificial Sequence: Synthetic polypeptide
  Heterodimeric Fc Backbone 4 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 1813 - protein, 216 aa, Artificial Sequence
  Description of Artificial Sequence: Synthetic polypeptide
  Heterodimeric Fc Backbone 4 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 1814 - protein, 216 aa, Artificial Sequence
  Description of Artificial Sequence: Synthetic polypeptide
  Heterodimeric Fc Backbone 5 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1815 - protein, 216 aa, Artificial Sequence
  Description of Artificial Sequence: Synthetic polypeptide
  Heterodimeric Fc Backbone 5 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1816 - protein, 216 aa, Artificial Sequence
  Description of Artificial Sequence: Synthetic polypeptide
  Heterodimeric Fc Backbone 6 monomer 1 (-)
APPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1817 - protein, 216 aa, Artificial Sequence
  Description of Artificial Sequence: Synthetic polypeptide
  Heterodimeric Fc Backbone 6 monomer 2 (+)
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1818 - protein, 216 aa, Artificial Sequence
  Description of Artificial Sequence: Synthetic polypeptide
  Heterodimeric Fc Backbone 7 monomer 1 (-)
APPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1819 - protein, 216 aa, Artificial Sequence
  Description of Artificial Sequence: Synthetic polypeptide
  Heterodimeric Fc Backbone 7 monomer 2 (+)
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1820 - protein, 217 aa, Artificial Sequence
  Description of Artificial Sequence: Synthetic polypeptide
  Heterodimeric Fc Backbone 8 monomer 1 (-)
APEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 1821 - protein, 217 aa, Artificial Sequence
  Description of Artificial Sequence: Synthetic polypeptide
  Heterodimeric Fc Backbone 8 monomer 2 (+)
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1822 - protein, 216 aa, Artificial Sequence
  Description of Artificial Sequence: Synthetic polypeptide
  Heterodimeric Fc Backbone 9 monomer 1 (-)
APPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 1823 - protein, 216 aa, Artificial Sequence
  Description of Artificial Sequence: Synthetic polypeptide
  Heterodimeric Fc Backbone 9 monomer 2 (+)
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1824 - protein, 216 aa, Artificial Sequence
  Description of Artificial Sequence: Synthetic polypeptide
  Heterodimeric Fc Backbone 10 monomer 1 (-)
APPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 1825 - protein, 216 aa, Artificial Sequence
  Description of Artificial Sequence: Synthetic polypeptide
  Heterodimeric Fc Backbone 10 monomer 2 (+)
APPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1826 - protein, 216 aa, Artificial Sequence
  Description of Artificial Sequence: Synthetic polypeptide
  Heterodimeric Fc Backbone 11 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1827 - protein, 216 aa, Artificial Sequence
  Description of Artificial Sequence: Synthetic polypeptide
  Heterodimeric Fc Backbone 11 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1828 - protein, 216 aa, Artificial Sequence
  Description of Artificial Sequence: Synthetic polypeptide
  Heterodimeric Fc Backbone 12 monomer 1 (-)
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1829 - protein, 216 aa, Artificial Sequence; identical to SEQ ID NO: 1806
  Description of Artificial Sequence: Synthetic polypeptide
  Heterodimeric Fc Backbone 12 monomer 2 (+)

SEQ ID NO: 1830 - protein, 216 aa, Artificial Sequence
  Description of Artificial Sequence: Synthetic polypeptide
  Heterodimeric Fc Backbone 13 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1831 - protein, 216 aa, Artificial Sequence
  Description of Artificial Sequence: Synthetic polypeptide
  Heterodimeric Fc Backbone 13 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1832 - protein, 216 aa, Artificial Sequence
  Description of Artificial Sequence: Synthetic polypeptide
  Heterodimeric Fc Backbone 14 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHAHYTQKSLSLSPGK

SEQ ID NO: 1833 - protein, 216 aa, Artificial Sequence
  Description of Artificial Sequence: Synthetic polypeptide
  Heterodimeric Fc Backbone 14 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 1834 - protein, 216 aa, Artificial Sequence
  Description of Artificial Sequence: Synthetic polypeptide
  Heterodimeric Fc Backbone 15 monomer 1 (-)
APPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVLHEALHAHYTQKSLSLSPGK

SEQ ID NO: 1835 - protein, 216 aa, Artificial Sequence
  Description of Artificial Sequence: Synthetic polypeptide
  Heterodimeric Fc Backbone 15 monomer 2 (+)
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVLHEALHAHYTQKSLSLSPGK

SEQ ID NO: 1836 - protein, 113 aa, Artificial Sequence
  Description of Artificial Sequence: Synthetic polypeptide
  IgG1 CH1(+) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 1837 - protein, 113 aa, Artificial Sequence
  Description of Artificial Sequence: Synthetic polypeptide
  IgG1 CH1(-) + hinge
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCP

SEQ ID NO: 1838 - protein, 110 aa, Artificial Sequence
  Description of Artificial Sequence: Synthetic polypeptide
  IgG2 CH1(+) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCP

SEQ ID NO: 1839 - protein, 110 aa, Artificial Sequence
  Description of Artificial Sequence: Synthetic polypeptide
  IgG2 CH1(-) + hinge
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCP

SEQ ID NO: 1840 - protein, 110 aa, Artificial Sequence
  Description of Artificial Sequence: Synthetic polypeptide
  IgG4 CH1(+) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCP

SEQ ID NO: 1841 - protein, 110 aa, Artificial Sequence
  Description of Artificial Sequence: Synthetic polypeptide
  IgG4 CH1(-) + hinge
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPSCP

SEQ ID NO: 1842 - protein, 98 aa, Artificial Sequence
  Description of Artificial Sequence: Synthetic polypeptide
  IgG1 CH1(+)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 1843 - protein, 98 aa, Artificial Sequence
  Description of Artificial Sequence: Synthetic polypeptide
  IgG1 CH1(-)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKV

SEQ ID NO: 1844 - protein, 98 aa, Artificial Sequence
  Description of Artificial Sequence: Synthetic polypeptide
  IgG2 CH1(+)
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTV

SEQ ID NO: 1845 - protein, 98 aa, Artificial Sequence
  Description of Artificial Sequence: Synthetic polypeptide
  IgG2 CH1(-)
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTV

SEQ ID NO: 1846 - protein, 98 aa, Artificial Sequence
  Description of Artificial Sequence: Synthetic polypeptide
  IgG4 CH1(+)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 1847 - protein, 98 aa, Artificial Sequence
  Description of Artificial Sequence: Synthetic polypeptide
  IgG4 CH1(-)
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRV

SEQ ID NO: 1848 - protein, 15 aa, Artificial Sequence
  Description of Artificial Sequence: Synthetic peptide
  IgG1 hinge
EPKSCDKTHTCPPCP

SEQ ID NO: 1849 - protein, 12 aa, Artificial Sequence
  Description of Artificial Sequence: Synthetic peptide
  IgG2 hinge
ERKCCVECPPCP

SEQ ID NO: 1850 - protein, 12 aa, Artificial Sequence
  Description of Artificial Sequence: Synthetic peptide
  IgG4 hinge
ESKYGPPCPSCP

SEQ ID NO: 1851 - protein, 107 aa, Artificial Sequence [sequence omitted]

SEQ ID NO: 1852 - protein, 106 aa, Artificial Sequence
  Description of Artificial Sequence: Synthetic polypeptide
  Constant Light Domain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1853 - protein, 442 aa, Artificial Sequence
  Description of Artificial Sequence: Synthetic polypeptide
  XENP16432 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1854 - protein, 214 aa, Artificial Sequence
  Description of Artificial Sequence: Synthetic polypeptide
  XENP16432 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1855 - protein, 567 aa, Homo sapiens
  sp|P37173 Human TGF-beta-RII sequence
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 1856 - protein, 144 aa, Homo sapiens
  sp|P37173|23-166 Human TGF-beta-RII sequence, extracellular domain
TIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQ

SEQ ID NO: 1857 - protein, 567 aa, Macaca fascicularis
  tr|A0A2K5WD91 Macaca fascicularis TGF-beta-RII sequence
MGRGLLRGLWPLHIVLWTRIASTIPPHVQKSVNNDMMVTDNNGAVKFPQLCKFCDVRFSTCDNQKSCLSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSSWEAGKPRKLMDFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 1858 - protein, 144 aa, Macaca fascicularis
  tr|A0A2K5WD91|23-166 Macaca fascicularis TGF-beta-RII sequence, extracellular domain (predicted)
TIPPHVQKSVNNDMMVTDNNGAVKFPQLCKFCDVRFSTCDNQKSCLSNCSITSICEKPQEVCVAVWRKNDENITLETVCHDPKLPYHDFILEDAASPKCIMKEKKKPGETFFMCSCSSDECNDNIIFSEEYNTSNPDLLLVIFQ

SEQ ID NO: 1859 - protein, 121 aa, Artificial Sequence; identical to SEQ ID NO: 525
  Description of Artificial Sequence: Synthetic polypeptide
  TBRII-A_H1 Variable Heavy Variable heavy (vh) domain

SEQ ID NO: 1860 - protein, 7 aa, Artificial Sequence
  Description of Artificial Sequence: Synthetic peptide
  TBRII-A_H1 Variable Heavy vhCDR1
NSYFSWG

SEQ ID NO: 1861 - protein, 16 aa, Artificial Sequence
  Description of Artificial Sequence: Synthetic peptide
  TBRII-A_H1 Variable Heavy vhCDR2
SFYYGEKTYYNPSLKS

SEQ ID NO: 1862 - protein, 11 aa, Artificial Sequence
  Description of Artificial Sequence: Synthetic peptide
  TBRII-A_H1 Variable Heavy vhCDR3
GPTMIRGVIDS

SEQ ID NO: 1863 - protein, 121 aa, Artificial Sequence; identical to SEQ ID NO: 1324
  Description of Artificial Sequence: Synthetic polypeptide
  TBRII-A_H1.1 Variable Heavy Variable heavy (vh) domain

SEQ ID NO: 1864 - protein, 7 aa, Artificial Sequence
  Description of Artificial Sequence: Synthetic peptide
  TBRII-A_H1.1 Variable Heavy vhCDR1
NSYFSWG

SEQ ID NO: 1865 - protein, 16 aa, Artificial Sequence
  Description of Artificial Sequence: Synthetic peptide
  TBRII-A_H1.1 Variable Heavy vhCDR2
SFYYGEKTYYNPSLKS

SEQ ID NO: 1866 - protein, 11 aa, Artificial Sequence
  Description of Artificial Sequence: Synthetic peptide
  TBRII-A_H1.1 Variable Heavy vhCDR3
GPTVIRGVIDS

SEQ ID NO: 1867 - protein, 107 aa, Artificial Sequence; identical to SEQ ID NO: 529
  Description of Artificial Sequence: Synthetic polypeptide
  TBRII-A_L1 Variable Light Variable light (vl) domain

SEQ ID NO: 1868 - protein, 11 aa, Artificial Sequence
  Description of Artificial Sequence: Synthetic peptide
  TBRII-A_L1 Variable Light vlCDR1
RASQSVRSYLA

SEQ ID NO: 1869 - protein, 7 aa, Artificial Sequence
  Description of Artificial Sequence: Synthetic peptide
  TBRII-A_L1 Variable Light vlCDR2
DASNRAT

SEQ ID NO: 1870 - protein, 9 aa, Artificial Sequence
  Description of Artificial Sequence: Synthetic peptide
  TBRII-A_L1 Variable Light vlCDR3
QQRSNWPPT

SEQ ID NO: 1871 - protein, 122 aa, Artificial Sequence; identical to SEQ ID NO: 888
  Description of Artificial Sequence: Synthetic polypeptide
  TBRII-B_H1 Variable Heavy Variable heavy (vh) domain

SEQ ID NO: 1872 - protein, 5 aa, Artificial Sequence
  Description of Artificial Sequence: Synthetic peptide
  TBRII-B_H1 Variable Heavy vhCDR1
TEQMW

SEQ ID NO: 1873 - protein, 17 aa, Artificial Sequence
  Description of Artificial Sequence: Synthetic peptide
  TBRII-B_H1 Variable Heavy vhCDR2
RIDSPGGRTYYANSVKG

SEQ ID NO: 1874 - protein, 13 aa, Artificial Sequence
  Description of Artificial Sequence: Synthetic peptide
  TBRII-B_H1 Variable Heavy vhCDR3
RRPTGVSGTFYDY

SEQ ID NO: 1875 - protein, 116 aa, Artificial Sequence; identical to SEQ ID NO: 549
  Description of Artificial Sequence: Synthetic polypeptide
  TBRII-C_H1 Variable Heavy Variable heavy (vh) domain

SEQ ID NO: 1876 - protein, 5 aa, Artificial Sequence
  Description of Artificial Sequence: Synthetic peptide
  TBRII-C_H1 Variable Heavy vhCDR1
SFSMN

SEQ ID NO: 1877 - protein, 17 aa, Artificial Sequence
  Description of Artificial Sequence: Synthetic peptide
  TBRII-C_H1 Variable Heavy vhCDR2
SISSSSSYIYYTDSVKG

SEQ ID NO: 1878 - protein, 7 aa, Artificial Sequence
  Description of Artificial Sequence: Synthetic peptide
  TBRII-C_H1 Variable Heavy vhCDR3
GYWGFDY

SEQ ID NO: 1879 - protein, 107 aa, Artificial Sequence; identical to SEQ ID NO: 553
  Description of Artificial Sequence: Synthetic polypeptide
  TBRII-C_L1 Variable Light Variable light (vl) domain

SEQ ID NO: 1880 - protein, 11 aa, Artificial Sequence
  Description of Artificial Sequence: Synthetic peptide
  TBRII-C_L1 Variable Light vlCDR1
RASQGIRNDLG

SEQ ID NO: 1881 - protein, 7 aa, Artificial Sequence
  Description of Artificial Sequence: Synthetic peptide
  TBRII-C_L1 Variable Light vlCDR2
AASSLQS

SEQ ID NO: 1882 - protein, 9 aa, Artificial Sequence
  Description of Artificial Sequence: Synthetic peptide
  TBRII-C_L1 Variable Light vlCDR3
LQHNSNPLT

SEQ ID NO: 1883 - protein, 450 aa, Artificial Sequence
  Description of Artificial Sequence: Synthetic polypeptide
  XENP28296 Chain 1 - TBRII-A[TGF-beta-RII]_H1_IgG1_PVA_/S267K Heavy Chain
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1884 - protein, 214 aa, Artificial Sequence
  Description of Artificial Sequence: Synthetic polypeptide
  XENP28296 Chain 2 - TBRII-A[TGF-beta-RII]_L1 Light Chain
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1885 - protein, 450 aa, Artificial Sequence
  Description of Artificial Sequence: Synthetic polypeptide
  XENP28297 Chain 1 - TBRII-A[TGF-beta-RII]_H1.1_IgG1_PVA_/S267K Heavy Chain
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1886 - protein, 214 aa, Artificial Sequence; identical to SEQ ID NO: 1884
  Description of Artificial Sequence: Synthetic polypeptide
  XENP28297 Chain 2 - TBRII-A[TGF-beta-RII]_L1 Light Chain

SEQ ID NO: 1887 - protein, 445 aa, Artificial Sequence
  Description of Artificial Sequence: Synthetic polypeptide
  XENP33038 Chain 1 - TBRII-C[TGF-beta-RII]_H1_IgG1_PVA_/S267K Heavy Chain
EVQLVESGGGLVKPGGSLRLSCAASGFTFSSFSMNWVRQAPGKGLEWVSSISSSSSYIYYTDSVKGRFTISRDNAKNSLYLQMNSLRAEDTAVYYCARGYWGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1888 - protein, 214 aa, Artificial Sequence
  Description of Artificial Sequence: Synthetic polypeptide
  XENP33038 Chain 2 - TBRII-C[TGF-beta-RII]_L1 Light Chain
DIQMTQSPSSLSASVGDRVTITCRASQGIRNDLGWYQQKPGKAPKRLIYAASSLQSGVPSRFSGSASGTEFTLTISSLQPEDFATYYCLQHNSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1889 - protein, 353 aa, Artificial Sequence
  Description of Artificial Sequence: Synthetic polypeptide
  XENP33040 TBRII-B[TGF-beta-RII]_H1_Fc(216)_IgG1_C220S/PVA_/S267K
EVQLLESGGGLVQPGGSLRLSCAASGFTFGTEQMWWVRQAPGKGLEFVSRIDSPGGRTYYANSVKGRFTISRDNSKNTLYLQMNSLRAEDTAVYYCAKRRPTGVSGTFYDYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1890 - protein, 288 aa, Homo sapiens
  sp|Q15116 Human PD-1 sequence
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 1891 - protein, 150 aa, Homo sapiens [sequence omitted]

SEQ ID NO: 1892 - protein, 288 aa, Macaca fascicularis
  tr|B0LAJ3 Macaca fascicularis PD-1 sequence
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 1893 - protein, 150 aa, Macaca fascicularis
  tr|B0LAJ3|21-170 Macaca fascicularis PD-1 sequence, extracellular domain (predicted)
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 1894 - protein, 483 aa, Artificial Sequence
  Description of Artificial Sequence: Synthetic polypeptide
  XENP33041 Chain 1 - mAb C[PD1]_H1_L1.1_scFv(GKPGS)4_Fc(216)_IgG1 _C220S/PVA_/S267K/S364K/E357Q
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSGKPGSGKPGSGKPGSGKPGSDIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1895 - protein, 445 aa, Artificial Sequence
  Description of Artificial Sequence: Synthetic polypeptide
  XENP33041 Chain 2 - TBRII-C[TGF-beta-RII]_H1_IgG1_pI(-)_ Isosteric_A_PVA_/S267K/L368D/K370S
EVQLVESGGGLVKPGGSLRLSCAASGFTFSSFSMNWVRQAPGKGLEWVSSISSSSSYIYYTDSVKGRFTISRDNAKNSLYLQMNSLRAEDTAVYYCARGYWGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1896 - protein, 214 aa, Artificial Sequence; identical to SEQ ID NO: 1888
  Description of Artificial Sequence: Synthetic polypeptide
  XENP33041 Chain 3 - TBRII-C[TGF-beta-RII]_L1 Light Chain

SEQ ID NO: 1897 - protein, 450 aa, Artificial Sequence
  Description of Artificial Sequence: Synthetic polypeptide
  XENP33044 Chain 1 - TBRII-A[TGF-beta-RII]_H1_IgG1_pI(-)_Isost eric_A_PVA_/S267K/L368D/K370S
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1898 - protein, 483 aa, Artificial Sequence; identical to SEQ ID NO: 1894
  Description of Artificial Sequence: Synthetic polypeptide
  XENP33044 Chain 2 - mAb C[PD1]_H1_L1.1_scFv(GKPGS)4_Fc(216)_ IgG1_C220S/PVA_/S267K/S364K/E357Q

SEQ ID NO: 1899 - protein, 214 aa, Artificial Sequence; identical to SEQ ID NO: 1884
  Description of Artificial Sequence: Synthetic polypeptide
  XENP33044 Chain 3 - TBRII-A[TGF-beta-RII]_L1 Light Chain

SEQ ID NO: 1900 - protein, 450 aa, Artificial Sequence
  Description of Artificial Sequence: Synthetic polypeptide
  XENP33045 Chain 1 - TBRII-A[TGF-beta-RII]_H1.1_IgG1_pI(-)_ Isosteric_A_PVA_/S267K/L368D/K370S
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1901 - protein, 483 aa, Artificial Sequence; identical to SEQ ID NO: 1894
  Description of Artificial Sequence: Synthetic polypeptide
  XENP33045 Chain 2 - mAb C[PD1]_H1_L1.1_scFv(GKPGS)4_Fc(216)_ IgG1_C220S/PVA_/S267K/S364K/E357Q

SEQ ID NO: 1902 - protein, 214 aa, Artificial Sequence; identical to SEQ ID NO: 1884
  Description of Artificial Sequence: Synthetic polypeptide
  XENP33045 Chain 3 - TBRII-A[TGF-beta-RII]_L1 Light Chain

SEQ ID NO: 1903 - protein, 448 aa, Artificial Sequence
  Description of Artificial Sequence: Synthetic polypeptide
  XENP34287 Chain 1 - mAb C[PD1]_H1_IgG1_pI(-)_Isosteric_A_ PVA_/S267K/L368D/K370S
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1904 - protein, 479 aa, Artificial Sequence
  Description of Artificial Sequence: Synthetic polypeptide
  XENP34287 Chain 2 - TBRII-A[TGF-beta-RII]_H1L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1905 - protein, 220 aa, Artificial Sequence
  Description of Artificial Sequence: Synthetic polypeptide
  XENP34287 Chain 3 - mAb C[PD1]_L1.1 Light Chain
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1906 - protein, 448 aa, Artificial Sequence; identical to SEQ ID NO: 1903
  Description of Artificial Sequence: Synthetic polypeptide
  XENP34288 Chain 1 - mAb C[PD1]_H1_IgG1_pI(-)_Isosteric_A_ PVA_/S267K/L368D/K370S

SEQ ID NO: 1907 - protein, 479 aa, Artificial Sequence
  Description of Artificial Sequence: Synthetic polypeptide
  XENP34288 Chain 2 - TBRII-A[TGF-beta-RII]_H1.1_L1_scFv(GKPGS)4_ Fc(216)_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1908 - protein, 220 aa, Artificial Sequence; identical to SEQ ID NO: 1905
  Description of Artificial Sequence: Synthetic polypeptide
  XENP34288 Chain 3 - mAb C[PD1]_L1.1 Light Chain

SEQ ID NO: 1909 - protein, 448 aa, Artificial Sequence; identical to SEQ ID NO: 1903
  Description of Artificial Sequence: Synthetic polypeptide
  XENP34289 Chain 1 - mAb C[PD1]_H1_IgG1_pI(-)_Isosteric_A_ PVA_/S267K/L368D/K370S

SEQ ID NO: 1910 - protein, 474 aa, Artificial Sequence
  Description of Artificial Sequence: Synthetic polypeptide
  XENP34289 Chain 2 - TBRII-C[TGF-beta-RII]_H1L1_scFv(GKPGS)4_ Fc(216_IgG1_C220S/PVA_/S267K/S364K/E357Q
EVQLVESGGGLVKPGGSLRLSCAASGFTFSSFSMNWVRQAPGKGLEWVSSISSSSSYIYYTDSVKGRFTISRDNAKNSLYLQMNSLRAEDTAVYYCARGYWGFDYWGQGTLVTVSSGKPGSGKPGSGKPGSGKPGSDIQMTQSPSSLSASVGDRVTITCRASQGIRNDLGWYQQKPGKAPKRLIYAASSLQSGVPSRFSGSASGTEFTLTISSLQPEDFATYYCLQHNSNPLTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1911 - protein, 220 aa, Artificial Sequence; identical to SEQ ID NO: 1905
  Description of Artificial Sequence: Synthetic polypeptide
  XENP34289 Chain 3 - mAb C[PD1]_L1.1 Light Chain

SEQ ID NO: 1912 - protein, 448 aa, Artificial Sequence; identical to SEQ ID NO: 1903
  Description of Artificial Sequence: Synthetic polypeptide
  XENP35103 Chain 1 - mAb C[PD1]_H1_IgG1_pI(-)_Isosteric_A_ PVA_/S267K/L368D/K370S

SEQ ID NO: 1913 - protein, 479 aa, Artificial Sequence
  Description of Artificial Sequence: Synthetic polypeptide
  XENP35103 Chain 2 - TBRII-A[TGF-beta-RII]_H1.21_L1_scFv(GKPGS)4_ Fc(216)_IgG1_C220S/PVA_/S267K/S364K/E357Q
QLQVQESGPGLVKPSETLSLTCTVSGGSISNSAFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1914 - protein, 220 aa, Artificial Sequence; identical to SEQ ID NO: 1905
  Description of Artificial Sequence: Synthetic polypeptide
  XENP35103 Chain 3 - mAb C[PD1]_L1.1 Light Chain

SEQ ID NO: 1915 - protein, 448 aa, Artificial Sequence; identical to SEQ ID NO: 1903
  Description of Artificial Sequence: Synthetic polypeptide
  XENP35104 Chain 1 - mAb C[PD1]_H1_IgG1_pI(-)_Isosteric_A_ PVA_/S267K/L368D/K370S

SEQ ID NO: 1916 - protein, 479 aa, Artificial Sequence
  Description of Artificial Sequence: Synthetic polypeptide
  XENP35104 Chain 2 - TBRII-A[TGF-beta-RII]_H1.29_L1_scFv(GKPGS)4_ Fc(216)_IgG1_C220S/PVA_/S267K/S364K/E357Q
QLQVQESGPGLVKPSETLSLTCTVSGGSISNSYFTWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1917 - protein, 220 aa, Artificial Sequence; identical to SEQ ID NO: 1905
  Description of Artificial Sequence: Synthetic polypeptide
  XENP35104 Chain 3 - mAb C[PD1]_L1.1 Light Chain

SEQ ID NO: 1918 - protein, 448 aa, Artificial Sequence; identical to SEQ ID NO: 1903
  Description of Artificial Sequence: Synthetic polypeptide
  XENP35105 Chain 1 - mAb C[PD1]_H1_IgG1_pI(-)_Isosteric_A_ PVA_/S267K/L368D/K370S

SEQ ID NO: 1919 - protein, 479 aa, Artificial Sequence
  Description of Artificial Sequence: Synthetic polypeptide
  XENP35105 Chain 2 - TBRII-A[TGF-beta-RII]_H1.30_L1_scFv(GKPGS)4_ Fc(216)_IgG1_C220S/PVA_/S267K/S364K/E357Q
QLQVQESGPGLVKPSETLSLTCTVSGGSISNSYFYWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1920 - protein, 220 aa, Artificial Sequence; identical to SEQ ID NO: 1905
  Description of Artificial Sequence: Synthetic polypeptide
  XENP35105 Chain 3 - mAb C[PD1]_L1.1 Light Chain

SEQ ID NO: 1921 - protein, 448 aa, Artificial Sequence; identical to SEQ ID NO: 1903
  Description of Artificial Sequence: Synthetic polypeptide
  XENP35106 Chain 1 - mAb C[PD1]_H1_IgG1_pI(-)_Isosteric_A_ PVA_/S267K/L368D/K370S

SEQ ID NO: 1922 - protein, 479 aa, Artificial Sequence
  Description of Artificial Sequence: Synthetic polypeptide
  XENP35106 Chain 2 - TBRII-A[TGF-beta-RII]_H1.33_L1_scFv(GKPGS)4_ Fc(216)_IgG1_C220S/PVA_/S267K/S364K/E357Q
QLQVQESGPGLVKPSETLSLTCTVSGGSISNSYFSWAWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1923 - protein, 220 aa, Artificial Sequence; identical to SEQ ID NO: 1905
  Description of Artificial Sequence: Synthetic polypeptide
  XENP35106 Chain 3 - mAb C[PD1]_L1.1 Light Chain

SEQ ID NO: 1924 - protein, 448 aa, Artificial Sequence; identical to SEQ ID NO: 1903
  Description of Artificial Sequence: Synthetic polypeptide
  XENP35107 Chain 1 - mAb C[PD1]_H1_IgG1_pI(-)_Isosteric_A_ PVA_/S267K/L368D/K370S

SEQ ID NO: 1925 - protein, 479 aa, Artificial Sequence
  Description of Artificial Sequence: Synthetic polypeptide
  XENP35107 Chain 2 - TBRII-A[TGF-beta-RII]_H1.36_L1_scFv(GKPGS)4_ Fc(216)_IgG1_C220S/PVA_/S267K/S364K/E357Q
QLQVQESGPGLVKPSETLSLTCTVSGGSISNSYFSWSWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1926 - protein, 220 aa, Artificial Sequence; identical to SEQ ID NO: 1905
  Description of Artificial Sequence: Synthetic polypeptide
  XENP35107 Chain 3 - mAb C[PD1]_L1.1 Light Chain

SEQ ID NO: 1927 - protein, 448 aa, Artificial Sequence; identical to SEQ ID NO: 1903
  Description of Artificial Sequence: Synthetic polypeptide
  XENP35108 Chain 1 - mAb C[PD1]_H1_IgG1_pI(-)_Isosteric_A_ PVA_/S267K/L368D/K370S

SEQ ID NO: 1928 - protein, 479 aa, Artificial Sequence
  Description of Artificial Sequence: Synthetic polypeptide
  XENP35108 Chain 2 - TBRII-A[TGF-beta-RII]_H1.37_L1_scFv(GKPGS)4_ Fc(216)_IgG1_C220S/PVA_/S267K/S364K/E357Q
QLQVQESGPGLVKPSETLSLTCTVSGGSISNSYFSWGWVRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1929 - protein, 220 aa, Artificial Sequence; identical to SEQ ID NO: 1905
  Description of Artificial Sequence: Synthetic polypeptide
  XENP35108 Chain 3 - mAb C[PD1]_L1.1 Light Chain

SEQ ID NO: 1930 - protein, 448 aa, Artificial Sequence; identical to SEQ ID NO: 1903
  Description of Artificial Sequence: Synthetic polypeptide
  XENP35109 Chain 1 - mAb C[PD1]_H1_IgG1_pI(-)_Isosteric_A_ PVA_/S267K/L368D/K370S

SEQ ID NO: 1931 - protein, 479 aa, Artificial Sequence
  Description of Artificial Sequence: Synthetic polypeptide
  XENP35109 Chain 2 - TBRII-A[TGF-beta-RII]_H1.51_L1_scFv(GKPGS)4_ Fc(216)_IgG1_C220S/PVA_/S267K/S364K/E357Q
QLQVQESGPGLVKPSETLSLTCTVSGGSISNSYFSWGWIRQPPGKGLEWIGSFNYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1932 - protein, 220 aa, Artificial Sequence; identical to SEQ ID NO: 1905
  Description of Artificial Sequence: Synthetic polypeptide
  XENP35109 Chain 3 - mAb C[PD1]_L1.1 Light Chain

SEQ ID NO: 1933 - protein, 448 aa, Artificial Sequence; identical to SEQ ID NO: 1903
  Description of Artificial Sequence: Synthetic polypeptide
  XENP35110 Chain 1 - mAb C[PD1]_H1_IgG1_pI(-)_Isosteric_A_ PVA_/S267K/L368D/K370S

SEQ ID NO: 1934 - protein, 479 aa, Artificial Sequence
  Description of Artificial Sequence: Synthetic polypeptide
  XENP35110 Chain 2 - TBRII-A[TGF-beta-RII]_H1.56_L1_scFv(GKPGS)4_ Fc(216)_IgG1_C220S/PVA_/S267K/S364K/E357Q
QLQVQESGPGLVKPSETLSLTCTVSGGSISNSYFSWGWIRQPPGKGLEWIGSFYYGGKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1935 - protein, 220 aa, Artificial Sequence; identical to SEQ ID NO: 1905
  Description of Artificial Sequence: Synthetic polypeptide
  XENP35110 Chain 3 - mAb C[PD1]_L1.1 Light Chain

SEQ ID NO: 1936 - protein, 448 aa, Artificial Sequence; identical to SEQ ID NO: 1903
  Description of Artificial Sequence: Synthetic polypeptide
  XENP35111 Chain 1 - mAb C[PD1]_H1_IgG1_pI(-)_Isosteric_A_ PVA_/S267K/L368D/K370S

SEQ ID NO: 1937 - protein, 479 aa, Artificial Sequence
  Description of Artificial Sequence: Synthetic polypeptide
  XENP35111 Chain 2 - TBRII-A[TGF-beta-RII]_H1.48_L1_scFv(GKPGS)4_ Fc(216)_IgG1_C220S/PVA_/S267K/S364K/E357Q
QLQVQESGPGLVKPSETLSLTCTVSGGSISNSYFSWGWIRQPPGKGLEWIGSFDYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1938 - protein, 220 aa, Artificial Sequence; identical to SEQ ID NO: 1905
  Description of Artificial Sequence: Synthetic polypeptide
  XENP35111 Chain 3 - mAb C[PD1]_L1.1 Light Chain

SEQ ID NO: 1939 - protein, 448 aa, Artificial Sequence; identical to SEQ ID NO: 1903
  Description of Artificial Sequence: Synthetic polypeptide
  XENP35112 Chain 1 - mAb C[PD1]_H1_IgG1_pI(-)_Isosteric_A_ PVA_/S267K/L368D/K370S

SEQ ID NO: 1940 - protein, 479 aa, Artificial Sequence
  Description of Artificial Sequence: Synthetic polypeptide
  XENP35112 Chain 2 - TBRII-A[TGF-beta-RII]_H1.50_L1_scFv(GKPGS)4_ Fc(216)_IgG1_C220S/PVA_/S267K/S364K/E357Q
QLQVQESGPGLVKPSETLSLTCTVSGGSISNSYFSWGWIRQPPGKGLEWIGSFKYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1941 - protein, 220 aa, Artificial Sequence; identical to SEQ ID NO: 1905
  Description of Artificial Sequence: Synthetic polypeptide
  XENP35112 Chain 3 - mAb C[PD1]_L1.1 Light Chain

SEQ ID NO: 1942 - protein, 448 aa, Artificial Sequence; identical to SEQ ID NO: 1903
  Description of Artificial Sequence: Synthetic polypeptide
  XENP35186 Chain 1 - mAb C[PD1]_H1_IgG1_pI(-)_Isosteric_A_ PVA_/S267K/L368D/K370S

SEQ ID NO: 1943 - protein, 479 aa, Artificial Sequence
  Description of Artificial Sequence: Synthetic polypeptide
  XENP35186 Chain 2 - TBRII-A[TGF RII]_L1_H1.1_scFv(GKPGS)4_Fc(216)_ IgG1_C220S/PVA_/S267K/S364K/E357Q
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGKPGSGKPGSGKPGSGKPGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTVIRGVIDSWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1944 - protein, 220 aa, Artificial Sequence; identical to SEQ ID NO: 1905
  Description of Artificial Sequence: Synthetic polypeptide
  XENP35186 Chain 3 - mAb C[PD1]_L1.1 Light Chain

SEQ ID NO: 1945 - protein, 448 aa, Artificial Sequence; identical to SEQ ID NO: 1903
  Description of Artificial Sequence: Synthetic polypeptide
  XENP35545 Chain 1 - mAb C[PD1]_H1_IgG1_pI(-)_Isosteric_A_ PVA_/S267K/L368D/K370S

SEQ ID NO: 1946 - protein, 479 aa, Artificial Sequence
  Description of Artificial Sequence: Synthetic polypeptide
  XENP35545 Chain 2 - TBRII-A[TGF RII]_H1.15_L1_scFv(GKPGS)4_ Fc(216_IgG1_C220S/PVA_/S267K/S364K/E357Q
QLQVQESGPGLVKPSETLSLTCTVSGGSISTSYFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1947 - protein, 220 aa, Artificial Sequence; identical to SEQ ID NO: 1905
  Description of Artificial Sequence: Synthetic polypeptide
  XENP35545 Chain 3 - mAb C[PD1]_L1.1 Light Chain

SEQ ID NO: 1948 - protein, 448 aa, Artificial Sequence; identical to SEQ ID NO: 1903
  Description of Artificial Sequence: Synthetic polypeptide
  XENP35546 Chain 1 - mAb C[PD1]_H1_IgG1_pI(-)_Isosteric_A_ PVA_/S267K/L368D/K370S

SEQ ID NO: 1949 - protein, 479 aa, Artificial Sequence
  Description of Artificial Sequence: Synthetic polypeptide
  XENP35546 Chain 2 - TBRII-A[TGF RII]_H1.18_L1_scFv(GKPGS)4_ Fc(216_IgG1_C220S/PVA_/S267K/S364K/E357Q
QLQVQESGPGLVKPSETLSLTCTVSGGSISNAYFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1950 - protein, 220 aa, Artificial Sequence; identical to SEQ ID NO: 1905
  Description of Artificial Sequence: Synthetic polypeptide
  XENP35546 Chain 3 - mAb C[PD1]_L1.1 Light Chain

SEQ ID NO: 1951 - protein, 448 aa, Artificial Sequence; identical to SEQ ID NO: 1903
  Description of Artificial Sequence: Synthetic polypeptide
  XENP35547 Chain 1 - mAb C[PD1]_H1_IgG1_pI(-)_Isosteric_A_ PVA_/S267K/L368D/K370S

SEQ ID NO: 1952 - protein, 479 aa, Artificial Sequence
  Description of Artificial Sequence: Synthetic polypeptide
  XENP35547 Chain 2 - TBRII-A[TGF RII]_H1.34_L1_scFv(GKPGS)4_ Fc(216_IgG1_C220S/PVA_/S267K/S364K/E357Q
QLQVQESGPGLVKPSETLSLTCTVSGGSISNSYFSWHWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1953 - protein, 220 aa, Artificial Sequence; identical to SEQ ID NO: 1905
  Description of Artificial Sequence: Synthetic polypeptide
  XENP35547 Chain 3 - mAb C[PD1]_L1.1 Light Chain

SEQ ID NO: 1954 - protein, 448 aa, Artificial Sequence; identical to SEQ ID NO: 1903
  Description of Artificial Sequence: Synthetic polypeptide
  XENP35548 Chain 1 - mAb C[PD1]_H1_IgG1_pI(-)_Isosteric_A_ PVA_/S267K/L368D/K370S

SEQ ID NO: 1955 - protein, 479 aa, Artificial Sequence
  Description of Artificial Sequence: Synthetic polypeptide
  XENP35548 Chain 2 - TBRII-A[TGF RII]_H1.78_L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1956 - protein, 220 aa, Artificial Sequence; identical to SEQ ID NO: 1905
  Description of Artificial Sequence: Synthetic polypeptide
  XENP35548 Chain 3 - mAb C[PD1]_L1.1 Light Chain

SEQ ID NO: 1957 - protein, 448 aa, Artificial Sequence; identical to SEQ ID NO: 1903
  Description of Artificial Sequence: Synthetic polypeptide
  XENP35549 Chain 1 - mAb C[PD1]_H1_IgG1_pI(-)_Isosteric_A_ PVA_/S267K/L368D/K370S

SEQ ID NO: 1958 - protein, 479 aa, Artificial Sequence
  Description of Artificial Sequence: Synthetic polypeptide
  XENP35549 Chain 2 - TBRII-A[TGF RII]_H1.86_L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1959 - protein, 220 aa, Artificial Sequence; identical to SEQ ID NO: 1905
  Description of Artificial Sequence: Synthetic polypeptide
  XENP35549 Chain 3 - mAb C[PD1]_L1.1 Light Chain

SEQ ID NO: 1960 - protein, 448 aa, Artificial Sequence; identical to SEQ ID NO: 1903
  Description of Artificial Sequence: Synthetic polypeptide
  XENP35550 Chain 1 - mAb C[PD1]_H1_IgG1_pI(-)_Isosteric_A_ PVA_/S267K/L368D/K370S

SEQ ID NO: 1961 - protein, 479 aa, Artificial Sequence
  Description of Artificial Sequence: Synthetic polypeptide
  XENP35550 Chain 2 - TBRII-A[TGF RII]_H1.103_L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDLWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1962 - protein, 220 aa, Artificial Sequence; identical to SEQ ID NO: 1905
  Description of Artificial Sequence: Synthetic polypeptide
  XENP35550 Chain 3 - mAb C[PD1]_L1.1 Light Chain

SEQ ID NO: 1963 - protein, 448 aa, Artificial Sequence; identical to SEQ ID NO: 1903
  Description of Artificial Sequence: Synthetic polypeptide
  XENP35551 Chain 1 - mAb C[PD1]_H1_IgG1_pI(-)_Isosteric_A_ PVA_/S267K/L368D/K370S

SEQ ID NO: 1964 - protein, 479 aa, Artificial Sequence
  Description of Artificial Sequence: Synthetic polypeptide
  XENP35551 Chain 2 - TBRII-A[TGF RII]_H1_L1.47_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSQWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1965 - protein, 220 aa, Artificial Sequence; identical to SEQ ID NO: 1905
  Description of Artificial Sequence: Synthetic polypeptide
  XENP35551 Chain 3 - mAb C[PD1]_L1.1 Light Chain

SEQ ID NO: 1966 - protein, 448 aa, Artificial Sequence; identical to SEQ ID NO: 1903
  Description of Artificial Sequence: Synthetic polypeptide
  XENP35552 Chain 1 - mAb C[PD1]_H1_IgG1_pI(-)_Isosteric_A_ PVA_/S267K/L368D/K370S

SEQ ID NO: 1967 - protein, 479 aa, Artificial Sequence
  Description of Artificial Sequence: Synthetic polypeptide
  XENP35552 Chain 2 - TBRII-A[TGF RII]_H1_L1.53_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1968 - protein, 220 aa, Artificial Sequence; identical to SEQ ID NO: 1905
  Description of Artificial Sequence: Synthetic polypeptide
  XENP35552 Chain 3 - mAb C[PD1]_L1.1 Light Chain

SEQ ID NO: 1969 - protein, 448 aa, Artificial Sequence
  Description of Artificial Sequence: Synthetic polypeptide
  XENP36124 Chain 1 - mAb C[PD1]_H1.19_IgG1_pI(-)_Isosteric_A_PVA_/ S267K/L368D/K370S
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1970 - protein, 479 aa, Artificial Sequence; identical to SEQ ID NO: 1907
  Description of Artificial Sequence: Synthetic polypeptide
  XENP36124 Chain 2 - TBRII-A[TGF RII]_H1.1_L1_scFv(GKPGS)4_Fc(216)_ IgG1_C220S/PVA_/S267K/S364K/E357Q

SEQ ID NO: 1971 - protein, 220 aa, Artificial Sequence
  Description of Artificial Sequence: Synthetic polypeptide
  XENP36124 Chain 3 - mAb C[PD1]_L1.140 Light Chain
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1972 - protein, 448 aa, Artificial Sequence
  Description of Artificial Sequence: Synthetic polypeptide
  XENP36125 Chain 1 - mAb C[PD1]_H1.169_IgG1_pI(-)_Isosteric_A_PVA_/ S267K/L368D/K370S
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1973 - protein, 479 aa, Artificial Sequence; identical to SEQ ID NO: 1907
  Description of Artificial Sequence: Synthetic polypeptide
  XENP36125 Chain 2 - TBRII-A[TGF RII]_H1.1_L1_scFv(GKPGS)4_Fc(216)_ IgG1_C220S/PVA_/S267K/S364K/E357Q

SEQ ID NO: 1974 - protein, 220 aa, Artificial Sequence; identical to SEQ ID NO: 1971
  Description of Artificial Sequence: Synthetic polypeptide
  XENP36125 Chain 3 - mAb C[PD1]_L1.140 Light Chain

SEQ ID NO: 1975 - protein, 448 aa, Artificial Sequence
  Description of Artificial Sequence: Synthetic polypeptide
  XENP36126 Chain 1 - mAb C[PD1]_H1.175_IgG1_pI(-)_Isosteric_A_PVA_/ S267K/L368D/K370S
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1976 - protein, 479 aa, Artificial Sequence; identical to SEQ ID NO: 1907
  Description of Artificial Sequence: Synthetic polypeptide
  XENP36126 Chain 2 - TBRII-A[TGF RII]_H1.1_L1_scFv(GKPGS)4_Fc(216)_ IgG1_C220S/PVA_/S267K/S364K/E357Q

SEQ ID NO: 1977 - protein, 220 aa, Artificial Sequence; identical to SEQ ID NO: 1971
  Description of Artificial Sequence: Synthetic polypeptide
  XENP36126 Chain 3 - mAb C[PD1]_L1.140 Light Chain

SEQ ID NO: 1978 - protein, 448 aa, Artificial Sequence
  Description of Artificial Sequence: Synthetic polypeptide
  XENP36127 Chain 1 - mAb C[PD1]_H1.176_IgG1_pI(-)_Isosteric_A_PVA_/ S267K/L368D/K370S
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVFSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1979 - protein, 479 aa, Artificial Sequence; identical to SEQ ID NO: 1907
  Description of Artificial Sequence: Synthetic polypeptide
  XENP36127 Chain 2 - TBRII-A[TGF RII]_H1.1_L1_scFv(GKPGS)4_Fc(216)_ IgG1_C220S/PVA_/S267K/S364K/E357Q

SEQ ID NO: 1980 - protein, 220 aa, Artificial Sequence; identical to SEQ ID NO: 1971
  Description of Artificial Sequence: Synthetic polypeptide
  XENP36127 Chain 3 - mAb C[PD1]_L1.140 Light Chain

SEQ ID NO: 1981 - protein, 448 aa, Artificial Sequence; identical to SEQ ID NO: 1903
  Description of Artificial Sequence: Synthetic polypeptide
  XENP36164 Chain 1 - mAb C[PD1]_H1_IgG1_pI(-)_Isosteric_A_ PVA_/S267K/L368D/K370S

SEQ ID NO: 1982 - protein, 479 aa, Artificial Sequence
  Description of Artificial Sequence: Synthetic polypeptide
  XENP36164 Chain 2 - TBRII-A[TGF RII]_H1.181_L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1983 - protein, 220 aa, Artificial Sequence; identical to SEQ ID NO: 1905
  Description of Artificial Sequence: Synthetic polypeptide
  XENP36164 Chain 3 - mAb C[PD1]_L1.1 Light Chain

SEQ ID NO: 1984 - protein, 448 aa, Artificial Sequence; identical to SEQ ID NO: 1903
  Description of Artificial Sequence: Synthetic polypeptide
  XENP36166 Chain 1 - mAb C[PD1]_H1_IgG1_pI(-)_Isosteric_A_ PVA_/S267K/L368D/K370S

SEQ ID NO: 1985 - protein, 479 aa, Artificial Sequence
  Description of Artificial Sequence: Synthetic polypeptide
  XENP36166 Chain 2 - TBRII-A[TGF RII]_H1.183_L1_scFv(GKPGS)4_ Fc(216_IgG1_C220S/PVA_/S267K/S364K/E357Q
QLQVQESGPGLVKPSETLSLTCTVSGGSISNSYFSWGWIRQPPGKGLEWIGSFYYGGKTYYNPSLKSRATISIDTSKNQFSLKLSSVTAADTAVYYCARGPTMIRGVFDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1986 - protein, 220 aa, Artificial Sequence; identical to SEQ ID NO: 1905
  Description of Artificial Sequence: Synthetic polypeptide
  XENP36166 Chain 3 - mAb C[PD1]_L1.1 Light Chain

SEQ ID NO: 1987 - protein, 448 aa, Artificial Sequence; identical to SEQ ID NO: 1903
  Description of Artificial Sequence: Synthetic polypeptide
  XENP36167 Chain 1 - mAb C[PD1]_H1_IgG1_pI(-)_Isosteric_A_ PVA_/S267K/L368D/K370S

SEQ ID NO: 1988 - protein, 479 aa, Artificial Sequence
  Description of Artificial Sequence: Synthetic polypeptide
  XENP36167 Chain 2 - TBRII-A[TGF RII]_H1.184_L1_scFv(GKPGS)4_ Fc(216_IgG1_C220S/PVA_/S267K/S364K/E357Q
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1989 - protein, 220 aa, Artificial Sequence; identical to SEQ ID NO: 1905
  Description of Artificial Sequence: Synthetic polypeptide
  XENP36167 Chain 3 - mAb C[PD1]_L1.1 Light Chain

SEQ ID NO: 1990 - protein, 448 aa, Artificial Sequence; identical to SEQ ID NO: 1903
  Description of Artificial Sequence: Synthetic polypeptide
  XENP36168 Chain 1 - mAb C[PD1]_H1_IgG1_pI(-)_Isosteric_A_ PVA_/S267K/L368D/K370S

SEQ ID NO: 1991 - protein, 479 aa, Artificial Sequence
  Description of Artificial Sequence: Synthetic polypeptide
  XENP36168 Chain 2 - TBRII-A[TGF RII]_H1.185_L1_scFv(GKPGS)4_ Fc(216_IgG1_C220S/PVA_/S267K/S364K/E357Q
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1992 - protein, 220 aa, Artificial Sequence; identical to SEQ ID NO: 1905
  Description of Artificial Sequence: Synthetic polypeptide
  XENP36168 Chain 3 - mAb C[PD1]_L1.1 Light Chain

SEQ ID NO: 1993 - protein, 448 aa, Artificial Sequence; identical to SEQ ID NO: 1903
  Description of Artificial Sequence: Synthetic polypeptide
  XENP36169 Chain 1 - mAb C[PD1]_H1_IgG1_pI(-)_Isosteric_A_ PVA_/S267K/L368D/K370S

SEQ ID NO: 1994 - protein, 479 aa, Artificial Sequence
  Description of Artificial Sequence: Synthetic polypeptide
  XENP36169 Chain 2 - TBRII-A[TGF RII]_H1.186_L1_scFv(GKPGS)4_ Fc(216_IgG1_C220S/PVA_/S267K/S364K/E357Q
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1995 - protein, 220 aa, Artificial Sequence; identical to SEQ ID NO: 1905
  Description of Artificial Sequence: Synthetic polypeptide
  XENP36169 Chain 3 - mAb C[PD1]_L1.1 Light Chain

SEQ ID NO: 1996 - protein, 448 aa, Artificial Sequence; identical to SEQ ID NO: 1903
  Description of Artificial Sequence: Synthetic polypeptide
  XENP36170 Chain 1 - mAb C[PD1]_H1_IgG1_pI(-)_Isosteric_A_ PVA_/S267K/L368D/K370S

SEQ ID NO: 1997 - protein, 479 aa, Artificial Sequence
  Description of Artificial Sequence: Synthetic polypeptide
  XENP36170 Chain 2 - TBRII-A[TGF RII]_H1.187_L1_scFv(GKPGS)4_ Fc(216_IgG1_C220S/PVA_/S267K/S364K/E357Q
QLQVQESGPGLVKPSETLSLTCTVSGGSISESYFSWGWIRQPPGKGLEWIGSFYYGGKTYYNPSLKSRATISIDTSKNQFSLKLSSVTAADTAVYYCARGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1998 - protein, 220 aa, Artificial Sequence; identical to SEQ ID NO: 1905
  Description of Artificial Sequence: Synthetic polypeptide
  XENP36170 Chain 3 - mAb C[PD1]_L1.1 Light Chain

SEQ ID NO: 1999 - protein, 448 aa, Artificial Sequence; identical to SEQ ID NO: 1903
  Description of Artificial Sequence: Synthetic polypeptide
  XENP36171 Chain 1 - mAb C[PD1]_H1_IgG1_pI(-)_Isosteric_A_ PVA_/S267K/L368D/K370S

SEQ ID NO: 2000 - protein, 479 aa, Artificial Sequence
  Description of Artificial Sequence: Synthetic polypeptide
  XENP36171 Chain 2 - TBRII-A[TGF RII]_H1.188_L1_scFv(GKPGS)4_ Fc(216_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2001 - protein, 220 aa, Artificial Sequence; identical to SEQ ID NO: 1905
  Description of Artificial Sequence: Synthetic polypeptide
  XENP36171 Chain 3 - mAb C[PD1]_L1.1 Light Chain

SEQ ID NO: 2002 - protein, 448 aa, Artificial Sequence; identical to SEQ ID NO: 1903
  Description of Artificial Sequence: Synthetic polypeptide
  XENP36172 Chain 1 - mAb C[PD1]_H1_IgG1_pI(-)_Isosteric_A_ PVA_/S267K/L368D/K370S

SEQ ID NO: 2003 - protein, 479 aa, Artificial Sequence
  Description of Artificial Sequence: Synthetic polypeptide
  XENP36172 Chain 2 - TBRII-A[TGF RII]_H1.189_L1_scFv(GKPGS)4_ Fc(216_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2004 - protein, 220 aa, Artificial Sequence; identical to SEQ ID NO: 1905
  Description of Artificial Sequence: Synthetic polypeptide
  XENP36172 Chain 3 - mAb C[PD1]_L1.1 Light Chain

SEQ ID NO: 2005 - protein, 448 aa, Artificial Sequence; identical to SEQ ID NO: 1903
  Description of Artificial Sequence: Synthetic polypeptide
  XENP36173 Chain 1 - mAb C[PD1]_H1_IgG1_pI(-)_Isosteric_A_ PVA_/S267K/L368D/K370S

SEQ ID NO: 2006 - protein, 479 aa, Artificial Sequence
  Description of Artificial Sequence: Synthetic polypeptide
  XENP36173 Chain 2 - TBRII-A[TGF RII]_H1.190_L1_scFv(GKPGS)4_ Fc(216_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2007 - protein, 220 aa, Artificial Sequence; identical to SEQ ID NO: 1905
  Description of Artificial Sequence: Synthetic polypeptide
  XENP36173 Chain 3 - mAb C[PD1]_L1.1 Light Chain

SEQ ID NO: 2008 - protein, 448 aa, Artificial Sequence; identical to SEQ ID NO: 1903
  Description of Artificial Sequence: Synthetic polypeptide
  XENP36174 Chain 1 - mAb C[PD1]_H1_IgG1_pI(-)_Isosteric_A_ PVA_/S267K/L368D/K370S

SEQ ID NO: 2009 - protein, 479 aa, Artificial Sequence
  Description of Artificial Sequence: Synthetic polypeptide
  XENP36174 Chain 2 - TBRII-A[TGF RII]_H1.191_L1_scFv(GKPGS)4_ Fc(216_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2010 - protein, 220 aa, Artificial Sequence; identical to SEQ ID NO: 1905
  Description of Artificial Sequence: Synthetic polypeptide
  XENP36174 Chain 3 - mAb C[PD1]_L1.1 Light Chain

SEQ ID NO: 2011 - protein, 448 aa, Artificial Sequence; identical to SEQ ID NO: 1903
  Description of Artificial Sequence: Synthetic polypeptide
  XENP36175 Chain 1 - mAb C[PD1]_H1_IgG1_pI(-)_Isosteric_A_ PVA_/S267K/L368D/K370S

SEQ ID NO: 2012 - protein, 479 aa, Artificial Sequence
  Description of Artificial Sequence: Synthetic polypeptide
  XENP36175 Chain 2 - TBRII-A[TGF RII]_H1.192_L1_scFv(GKPGS)4_ Fc(216_IgG1_C220S/PVA_/S267K/S364K/E357Q
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2013 - protein, 220 aa, Artificial Sequence; identical to SEQ ID NO: 1905
  Description of Artificial Sequence: Synthetic polypeptide
  XENP36175 Chain 3 - mAb C[PD1]_L1.1 Light Chain

SEQ ID NO: 2014 - protein, 448 aa, Artificial Sequence; identical to SEQ ID NO: 1903
  Description of Artificial Sequence: Synthetic polypeptide
  XENP36176 Chain 1 - mAb C[PD1]_H1_IgG1_pI(-)_Isosteric_A_ PVA_/S267K/L368D/K370S

SEQ ID NO: 2015 - protein, 479 aa, Artificial Sequence
  Description of Artificial Sequence: Synthetic polypeptide
  XENP36176 Chain 2 - TBRII-A[TGF RII]_H1.193_L1_scFv(GKPGS)4_ Fc(216_IgG1_C220S/PVA_/S267K/S364K/E357Q
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2016 - protein, 220 aa, Artificial Sequence; identical to SEQ ID NO: 1905
  Description of Artificial Sequence: Synthetic polypeptide
  XENP36176 Chain 3 - mAb C[PD1]_L1.1 Light Chain

SEQ ID NO: 2017 - protein, 448 aa, Artificial Sequence; identical to SEQ ID NO: 1903
  Description of Artificial Sequence: Synthetic polypeptide
  XENP36177 Chain 1 - mAb C[PD1]_H1_IgG1_pI(-)_Isosteric_A_ PVA_/S267K/L368D/K370S

SEQ ID NO: 2018 - protein, 479 aa, Artificial Sequence
  Description of Artificial Sequence: Synthetic polypeptide
  XENP36177 Chain 2 - TBRII-A[TGF RII]_H1.194_L1_scFv(GKPGS)4_ Fc(216_IgG1_C220S/PVA_/S267K/S364K/E357Q
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2019 - protein, 220 aa, Artificial Sequence; identical to SEQ ID NO: 1905
  Description of Artificial Sequence: Synthetic polypeptide
  XENP36177 Chain 3 - mAb C[PD1]_L1.1 Light Chain

SEQ ID NO: 2020 - protein, 448 aa, Artificial Sequence; identical to SEQ ID NO: 1903
  Description of Artificial Sequence: Synthetic polypeptide
  XENP36178 Chain 1 - mAb C[PD1]_H1_IgG1_pI(-)_Isosteric_A_ PVA_/S267K/L368D/K370S

SEQ ID NO: 2021 - protein, 479 aa, Artificial Sequence
  Description of Artificial Sequence: Synthetic polypeptide
  XENP36178 Chain 2 - TBRII-A[TGF RII]_H1.195_L1_scFv(GKPGS)4_ Fc(216_IgG1_C220S/PVA_/S267K/S364K/E357Q
QLQVQESGPGLVKPSETLSLTCTVSGGSISTSYFSWGWIRQPPGKGLEWIGSFYYGGKTYYNPSLKSRATISIDTSKNQFSLKLSSVTAADTAVYYCARGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2022 - protein, 220 aa, Artificial Sequence; identical to SEQ ID NO: 1905
  Description of Artificial Sequence: Synthetic polypeptide
  XENP36178 Chain 3 - mAb C[PD1]_L1.1 Light Chain

SEQ ID NO: 2023 - protein, 448 aa, Artificial Sequence; identical to SEQ ID NO: 1903
  Description of Artificial Sequence: Synthetic polypeptide
  XENP36179 Chain 1 - mAb C[PD1]_H1_IgG1_pI(-)_Isosteric_A_ PVA_/S267K/L368D/K370S

SEQ ID NO: 2024 - protein, 479 aa, Artificial Sequence
  Description of Artificial Sequence: Synthetic polypeptide
  XENP36179 Chain 2 - TBRII-A[TGF RII]_H1.196_L1_scFv(GKPGS)4_ Fc(216_IgG1_C220S/PVA_/S267K/S364K/E357Q
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2025 - protein, 220 aa, Artificial Sequence; identical to SEQ ID NO: 1905
  Description of Artificial Sequence: Synthetic polypeptide
  XENP36179 Chain 3 - mAb C[PD1]_L1.1 Light Chain

SEQ ID NO: 2026 - protein, 448 aa, Artificial Sequence; identical to SEQ ID NO: 1903
  Description of Artificial Sequence: Synthetic polypeptide
  XENP36180 Chain 1 - mAb C[PD1]_H1_IgG1_pI(-)_Isosteric_A_ PVA_/S267K/L368D/K370S

SEQ ID NO: 2027 - protein, 479 aa, Artificial Sequence
  Description of Artificial Sequence: Synthetic polypeptide
  XENP36180 Chain 2 - TBRII-A[TGF RII]_H1.197_L1_scFv(GKPGS)4_ Fc(216_IgG1_C220S/PVA_/S267K/S364K/E357Q
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2028 - protein, 220 aa, Artificial Sequence; identical to SEQ ID NO: 1905
  Description of Artificial Sequence: Synthetic polypeptide
  XENP36180 Chain 3 - mAb C[PD1]_L1.1 Light Chain

SEQ ID NO: 2029 - protein, 448 aa, Artificial Sequence; identical to SEQ ID NO: 1903
  Description of Artificial Sequence: Synthetic polypeptide
  XENP36181 Chain 1 - mAb C[PD1]_H1_IgG1_pI(-)_Isosteric_A_ PVA_/S267K/L368D/K370S

SEQ ID NO: 2030 - protein, 479 aa, Artificial Sequence
  Description of Artificial Sequence: Synthetic polypeptide
  XENP36181 Chain 2 - TBRII-A[TGF RII]_H1.198_L1_scFv(GKPGS)4_ Fc(216_IgG1_C220S/PVA_/S267K/S364K/E357Q
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2031 - protein, 220 aa, Artificial Sequence; identical to SEQ ID NO: 1905
  Description of Artificial Sequence: Synthetic polypeptide
  XENP36181 Chain 3 - mAb C[PD1]_L1.1 Light Chain

SEQ ID NO: 2032 - protein, 448 aa, Artificial Sequence; identical to SEQ ID NO: 1903
  Description of Artificial Sequence: Synthetic polypeptide
  XENP36182 Chain 1 - mAb C[PD1]_H1_IgG1_pI(-)_Isosteric_A_ PVA_/S267K/L368D/K370S

SEQ ID NO: 2033 - protein, 479 aa, Artificial Sequence
  Description of Artificial Sequence: Synthetic polypeptide
  XENP36182 Chain 2 - TBRII-A[TGF RII]_H1.199_L1_scFv(GKPGS)4_ Fc(216_IgG1_C220S/PVA_/S267K/S364K/E357Q
QLQVQESGPGLVKPSETLSLTCTVSGGSISQSYFSWGWIRQPPGKGLEWIGSFYYGGKTYYNPSLKSRATISIDTSKNQFSLKLSSVTAADTAVYYCARGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2034 - protein, 220 aa, Artificial Sequence; identical to SEQ ID NO: 1905
  Description of Artificial Sequence: Synthetic polypeptide
  XENP36182 Chain 3 - mAb C[PD1]_L1.1 Light Chain

SEQ ID NO: 2035 - protein, 448 aa, Artificial Sequence; identical to SEQ ID NO: 1903
  Description of Artificial Sequence: Synthetic polypeptide
  XENP36183 Chain 1 - mAb C[PD1]_H1_IgG1_pI(-)_Isosteric_A_ PVA_/S267K/L368D/K370S

SEQ ID NO: 2036 - protein, 479 aa, Artificial Sequence
  Description of Artificial Sequence: Synthetic polypeptide
  XENP36183 Chain 2 - TBRII-A[TGF RII]_H1.200_L1_scFv(GKPGS)4_ Fc(216_IgG1_C220S/PVA_/S267K/S364K/E357Q
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTMIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2037 - protein, 220 aa, Artificial Sequence; identical to SEQ ID NO: 1905
  Description of Artificial Sequence: Synthetic polypeptide
  XENP36183 Chain 3 - mAb C[PD1]_L1.1 Light Chain

SEQ ID NO: 2038 - protein, 448 aa, Artificial Sequence; identical to SEQ ID NO: 1903
  Description of Artificial Sequence: Synthetic polypeptide
  XENP36184 Chain 1 - mAb C[PD1]_H1_IgG1_pI(-)_Isosteric_A_ PVA_/S267K/L368D/K370S

SEQ ID NO: 2039 - protein, 479 aa, Artificial Sequence
  Description of Artificial Sequence: Synthetic polypeptide
  XENP36184 Chain 2 - TBRII-A[TGF RII]_H1.201_L1_scFv(GKPGS)4_ Fc(216_IgG1_C220S/PVA_/S267K/S364K/E357Q
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2040 - protein, 220 aa, Artificial Sequence; identical to SEQ ID NO: 1905
  Description of Artificial Sequence: Synthetic polypeptide
  XENP36184 Chain 3 - mAb C[PD1]_L1.1 Light Chain

SEQ ID NO: 2041 - protein, 448 aa, Artificial Sequence; identical to SEQ ID NO: 1903
  Description of Artificial Sequence: Synthetic polypeptide
  XENP36185 Chain 1 - mAb C[PD1]_H1_IgG1_pI(-)_Isosteric_A_ PVA_/S267K/L368D/K370S

SEQ ID NO: 2042 - protein, 479 aa, Artificial Sequence
  Description of Artificial Sequence: Synthetic polypeptide
  XENP36185 Chain 2 - TBRII-A[TGF RII]_H1.202_L1_scFv(GKPGS)4_ Fc(216_IgG1_C220S/PVA_/S267K/S364K/E357Q
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2043 - protein, 220 aa, Artificial Sequence; identical to SEQ ID NO: 1905
  Description of Artificial Sequence: Synthetic polypeptide
  XENP36185 Chain 3 - mAb C[PD1]_L1.1 Light Chain

SEQ ID NO: 2044 - protein, 448 aa, Artificial Sequence; identical to SEQ ID NO: 1903
  Description of Artificial Sequence: Synthetic polypeptide
  XENP36186 Chain 1 - mAb C[PD1]_H1_IgG1_pI(-)_Isosteric_A_ PVA_/S267K/L368D/K370S

SEQ ID NO: 2045 - protein, 479 aa, Artificial Sequence
  Description of Artificial Sequence: Synthetic polypeptide
  XENP36186 Chain 2 - TBRII-A[TGF RII]_H1.203_L1_scFv(GKPGS)4_ Fc(216_IgG1_C220S/PVA_/S267K/S364K/E357Q
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTVIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2046 - protein, 220 aa, Artificial Sequence; identical to SEQ ID NO: 1905
  Description of Artificial Sequence: Synthetic polypeptide
  XENP36186 Chain 3 - mAb C[PD1]_L1.1 Light Chain

SEQ ID NO: 2047 - protein, 448 aa, Artificial Sequence
  Description of Artificial Sequence: Synthetic polypeptide
  XENP37307 Chain 1 - mAb C[PD1]_H1_IgG1_pI(-)_Isosteric_A_ PVA_/S267K/L368D/K370S/M428L/N434S
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2048 - protein, 479 aa, Artificial Sequence
  Description of Artificial Sequence: Synthetic polypeptide
  XENP37307 Chain 2 - TBRII-A[TGF RII]_H1.201_L1_scFv(GKPGS)4_ Fc(216_IgG1_C220S/PVA_/S267K/S364K/E357Q/M428L/N434S
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2049 - protein, 220 aa, Artificial Sequence; identical to SEQ ID NO: 1905
  Description of Artificial Sequence: Synthetic polypeptide
  XENP37307 Chain 3 - mAb C[PD1]_L1.1 Light Chain

SEQ ID NO: 2050 - protein, 448 aa, Artificial Sequence
  Description of Artificial Sequence: Synthetic polypeptide
  XENP37310 Chain 1 - mAb C[PD1]_H1.176_IgG1_pI(-)_Isosteric_A_PVA_/ S267K/L368D/K370S/M428L/N434S
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVFSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2051 - protein, 479 aa, Artificial Sequence; identical to SEQ ID NO: 2048
  Description of Artificial Sequence: Synthetic polypeptide
  XENP37310 Chain 2 - TBRII-A[TGF RII]_H1.201_L1_scFv(GKPGS)4_ Fc(216_IgG1_C220S/PVA_/S267K/S364K/E357Q/M428L/N434S

SEQ ID NO: 2052 - protein, 220 aa, Artificial Sequence; identical to SEQ ID NO: 1971
  Description of Artificial Sequence: Synthetic polypeptide
  XENP37310 Chain 3 - mAb C[PD1]_L1.140 Light Chain

SEQ ID NO: 2053 - protein, 353 aa, Artificial Sequence
  Description of Artificial Sequence: Synthetic polypeptide
  XENP33043 Chain 1 - TBRII-B[TGF-beta-RII]_H1_VHH_Fc(216)_IgG1_pI(-) _Isosteric_A_C220S/PVA_/S267K/L368D/K370S
EVQLLESGGGLVQPGGSLRLSCAASGFTFGTEQMWWVRQAPGKGLEFVSRIDSPGGRTYYANSVKGRFTISRDNSKNTLYLQMNSLRAEDTAVYYCAKRRPTGVSGTFYDYWGQGTLVTVSSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2054 - protein, 483 aa, Artificial Sequence; identical to SEQ ID NO: 1894
  Description of Artificial Sequence: Synthetic polypeptide
  XENP33043 Chain 2 - mAb C[PD1]_H1_L1.1_scFv(GKPGS)4_Fc(216)_ IgG1_C220S/PVA_/S267K/S364K/E357Q

SEQ ID NO: 2055 - protein, 448 aa, Artificial Sequence
  Description of Artificial Sequence: Synthetic polypeptide
  XENP33046 Chain 1 - mAb C[PD1]_H1_IgG1_PVA_/S267K /S364K/E357Q
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2056 - protein, 353 aa, Artificial Sequence; identical to SEQ ID NO: 2053
  Description of Artificial Sequence: Synthetic polypeptide
  XENP33046 Chain 2 - TBRII-B[TGF-beta-RII]_H1_VHH_Fc(216)_IgG1_pI(-) _Isosteric_A_C220S/PVA_/S267K/L368D/K370S

SEQ ID NO: 2057 - protein, 220 aa, Artificial Sequence; identical to SEQ ID NO: 1905
  Description of Artificial Sequence: Synthetic polypeptide
  XENP33046 Chain 3 - mAb C[PD1]_L1.1 Light Chain

SEQ ID NO: 2058 - protein, 448 aa, Artificial Sequence; identical to SEQ ID NO: 1903
  Description of Artificial Sequence: Synthetic polypeptide
  XENP33047 Chain 1 - mAb C[PD1]_H1_IgG1_pI(-)_Isosteric_A_ PVA_/S267K/L368D/K370S

SEQ ID NO: 2059 - protein, 353 aa, Artificial Sequence
  Description of Artificial Sequence: Synthetic polypeptide
  XENP33047 Chain 2 - TBRII-B[TGF-beta-RII]_H1_VHH_Fc(216)_IgG1_ C220S/PVA_/S267K/S364K/E357Q
EVQLLESGGGLVQPGGSLRLSCAASGFTFGTEQMWWVRQAPGKGLEFVSRIDSPGGRTYYANSVKGRFTISRDNSKNTLYLQMNSLRAEDTAVYYCAKRRPTGVSGTFYDYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2060 - protein, 220 aa, Artificial Sequence; identical to SEQ ID NO: 1905
  Description of Artificial Sequence: Synthetic polypeptide
  XENP33047 Chain 3 - mAb C[PD1]_L1.1 Light Chain

SEQ ID NO: 2061 - protein, 445 aa, Artificial Sequence; identical to SEQ ID NO: 1895
  Description of Artificial Sequence: Synthetic polypeptide
  XENP34300 Chain 1 - TBRII-C[TGF-beta-RII]_H1_IgG1_pI(-)_Isost eric_A_PVA_/S267K/L368D/K370S

SEQ ID NO: 2062 - protein, 477 aa, Artificial Sequence
  Description of Artificial Sequence: Synthetic polypeptide
  XENP34300 Chain 2 - Numax_VHVL_scFv(GKPGS)4_Fc(216)_IgG1_C220S /PVA_/S267K/S364K/E357Q
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSGKPGSGKPGSGKPGSGKPGSDIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2063 - protein, 214 aa, Artificial Sequence; identical to SEQ ID NO: 1888
  Description of Artificial Sequence: Synthetic polypeptide
  XENP34300 Chain 3 - TBRII-C[TGF-beta-RII]_L1 Light Chain

SEQ ID NO: 2064 - protein, 450 aa, Artificial Sequence; identical to SEQ ID NO: 1897
  Description of Artificial Sequence: Synthetic polypeptide
  XENP34301 Chain 1 - TBRII-A[TGF-beta-RII]_H1_IgG1_pI(-)_Isost eric_A_PVA_/S267K/L368D/K370S

SEQ ID NO: 2065 - protein, 477 aa, Artificial Sequence; identical to SEQ ID NO: 2062
  Description of Artificial Sequence: Synthetic polypeptide
  XENP34301 Chain 2 - Numax_VHVL_scFv(GKPGS)4_Fc(216)_IgG1_C220S /PVA_/S267K/S364K/E357Q

SEQ ID NO: 2066 - protein, 214 aa, Artificial Sequence; identical to SEQ ID NO: 1884
  Description of Artificial Sequence: Synthetic polypeptide
  XENP34301 Chain 3 - TBRII-A[TGF-beta-RII]_L1 Light Chain

SEQ ID NO: 2067 - protein, 450 aa, Artificial Sequence; identical to SEQ ID NO: 1900
  Description of Artificial Sequence: Synthetic polypeptide
  XENP34302 Chain 1 - TBRII-A[TGF-beta-RII]_H1.1_IgG1_pI(-)_ Isosteric_A_PVA_/S267K/L368D/K370S

SEQ ID NO: 2068 - protein, 477 aa, Artificial Sequence; identical to SEQ ID NO: 2062
  Description of Artificial Sequence: Synthetic polypeptide
  XENP34302 Chain 2 - Numax_VHVL_scFv(GKPGS)4_Fc(216)_IgG1_C220S /PVA_/S267K/S364K/E357Q

SEQ ID NO: 2069 - protein, 214 aa, Artificial Sequence; identical to SEQ ID NO: 1884
  Description of Artificial Sequence: Synthetic polypeptide
  XENP34302 Chain 3 - TBRII-A[TGF-beta-RII]_L1 Light Chain

SEQ ID NO: 2070 - protein, 449 aa, Artificial Sequence
  Description of Artificial Sequence: Synthetic polypeptide
  XENP34303 Chain 1 - Numax_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2071 - protein, 353 aa, Artificial Sequence; identical to SEQ ID NO: 2053
  Description of Artificial Sequence: Synthetic polypeptide
  XENP34303 Chain 2 - TBRII-B[TGF-beta-RII]_H1_VHH_Fc(216)_IgG1_pI(-) _Isosteric_A_C220S/PVA_/S267K/L368D/K370S

SEQ ID NO: 2072 - protein, 213 aa, Artificial Sequence
  Description of Artificial Sequence: Synthetic polypeptide
  XENP34303 Chain 3 - Numax Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2073 - protein, 449 aa, Artificial Sequence
  Description of Artificial Sequence: Synthetic polypeptide
  XENP34304 Chain 1 - Numax_IgG1_pI(-)_Isosteric_A_PVA_/ S267K/L368D/K370S
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2074 - protein, 353 aa, Artificial Sequence; identical to SEQ ID NO: 2059
  Description of Artificial Sequence: Synthetic polypeptide
  XENP34304 Chain 2 - TBRII-B[TGF-beta-RII]_H1_VHH_Fc(216)_IgG1_ C220S/PVA_/S267K/S364K/E357Q

SEQ ID NO: 2075 - protein, 213 aa, Artificial Sequence; identical to SEQ ID NO: 2072
  Description of Artificial Sequence: Synthetic polypeptide
  XENP34304 Chain 3 - Numax Light Chain

SEQ ID NO: 2076 - protein, 449 aa, Artificial Sequence; identical to SEQ ID NO: 2073
  Description of Artificial Sequence: Synthetic polypeptide
  XENP34305 Chain 1 - Numax_IgG1_pI(-)_Isosteric_A_PVA_/ S267K/L368D/K370S

SEQ ID NO: 2077 - protein, 479 aa, Artificial Sequence; identical to SEQ ID NO: 1904
  Description of Artificial Sequence: Synthetic polypeptide
  XENP34305 Chain 2 - TBRII-A[TGF-beta-RII]_H1L1_scFv(GKPGS)4_ Fc(216_IgG1_C220S/PVA_/S267K/S364K/E357Q

SEQ ID NO: 2078 - protein, 213 aa, Artificial Sequence; identical to SEQ ID NO: 2072
  Description of Artificial Sequence: Synthetic polypeptide
  XENP34305 Chain 3 - Numax Light Chain

SEQ ID NO: 2079 - protein, 449 aa, Artificial Sequence; identical to SEQ ID NO: 2073
  Description of Artificial Sequence: Synthetic polypeptide
  XENP34306 Chain 1 - Numax_IgG1_pI(-)_Isosteric_A_PVA_/ S267K/L368D/K370S

SEQ ID NO: 2080 - protein, 479 aa, Artificial Sequence; identical to SEQ ID NO: 1907
  Description of Artificial Sequence: Synthetic polypeptide
  XENP34306 Chain 2 - TBRII-A[TGF-beta-RII]_H1.1_L1_scFv(GKPGS)4_ Fc(216)_IgG1_C220S/PVA_/S267K/S364K/E357Q

SEQ ID NO: 2081 - protein, 213 aa, Artificial Sequence; identical to SEQ ID NO: 2072
  Description of Artificial Sequence: Synthetic polypeptide
  XENP34306 Chain 3 - Numax Light Chain

SEQ ID NO: 2082 - protein, 449 aa, Artificial Sequence; identical to SEQ ID NO: 2073
  Description of Artificial Sequence: Synthetic polypeptide
  XENP34307 Chain 1 - Numax_IgG1_pI(-)_Isosteric_A_PVA_/ S267K/L368D/K370S

SEQ ID NO: 2083 - protein, 474 aa, Artificial Sequence; identical to SEQ ID NO: 1910
  Description of Artificial Sequence: Synthetic polypeptide
  XENP34307 Chain 2 - TBRII-C[TGF-beta-RII]_H1L1_scFv(GKPGS)4_ Fc(216_IgG1_C220S/PVA_/S267K/S364K/E357Q

SEQ ID NO: 2084 - protein, 213 aa, Artificial Sequence; identical to SEQ ID NO: 2072
  Description of Artificial Sequence: Synthetic polypeptide
  XENP34307 Chain 3 - Numax Light Chain

SEQ ID NO: 2085 - protein, 449 aa, Artificial Sequence; identical to SEQ ID NO: 2073
  Description of Artificial Sequence: Synthetic polypeptide
  XENP35119 Chain 1 - Numax_VH_IgG1_pI(-)_Isosteric_A_PVA_/ S267K/L368D/K370S

SEQ ID NO: 2086 - protein, 479 aa, Artificial Sequence; identical to SEQ ID NO: 1913
  Description of Artificial Sequence: Synthetic polypeptide
  XENP35119 Chain 2 - TBRII-A[TGF-beta-RII]_H1.21_L1_scFv(GKPGS)4_ Fc(216)_IgG1_C220S/PVA_/S267K/S364K/E357Q

SEQ ID NO: 2087 - protein, 213 aa, Artificial Sequence; identical to SEQ ID NO: 2072
  Description of Artificial Sequence: Synthetic polypeptide
  XENP35119 Chain 3 - Numax Light Chain

SEQ ID NO: 2088 - protein, 449 aa, Artificial Sequence; identical to SEQ ID NO: 2073
  Description of Artificial Sequence: Synthetic polypeptide
  XENP35120 Chain 1 - Numax_VH_IgG1_pI(-)_Isosteric_A_PVA_/ S267K/L368D/K370S

SEQ ID NO: 2089 - protein, 479 aa, Artificial Sequence; identical to SEQ ID NO: 1916
  Description of Artificial Sequence: Synthetic polypeptide
  XENP35120 Chain 2 - TBRII-A[TGF-beta-RII]_H1.29_L1_scFv(GKPGS)4_ Fc(216)_IgG1_C220S/PVA_/S267K/S364K/E357Q

SEQ ID NO: 2090 - protein, 213 aa, Artificial Sequence; identical to SEQ ID NO: 2072
  Description of Artificial Sequence: Synthetic polypeptide
  XENP35120 Chain 3 - Numax Light Chain

SEQ ID NO: 2091 - protein, 449 aa, Artificial Sequence; identical to SEQ ID NO: 2073
  Description of Artificial Sequence: Synthetic polypeptide
  XENP35121 Chain 1 - Numax_VH_IgG1_pI(-)_Isosteric_A_PVA_/ S267K/L368D/K370S

SEQ ID NO: 2092 - protein, 479 aa, Artificial Sequence; identical to SEQ ID NO: 1919
  Description of Artificial Sequence: Synthetic polypeptide
  XENP35121 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2093 - protein, 213 aa, Artificial Sequence; identical to SEQ ID NO: 2072
  Description of Artificial Sequence: Synthetic polypeptide
  XENP35121 Chain 3 - Numax Light Chain

SEQ ID NO: 2094 - protein, 449 aa, Artificial Sequence; identical to SEQ ID NO: 2073
  Description of Artificial Sequence: Synthetic polypeptide
  XENP35122 Chain 1 - Numax_VH_IgG1_pI(-)_Isosteric_A_PVA_/ S267K/L368D/K370S

SEQ ID NO: 2095 - protein, 479 aa, Artificial Sequence; identical to SEQ ID NO: 1922
  Description of Artificial Sequence: Synthetic polypeptide
  XENP35122 Chain 2 - TBRII-A[TGF-beta-RII]_H1.33_L1_scFv(GKPGS)4_ Fc(216)_IgG1_C220S/PVA_/S267K/S364K/E357Q

SEQ ID NO: 2096 - protein, 213 aa, Artificial Sequence; identical to SEQ ID NO: 2072
  Description of Artificial Sequence: Synthetic polypeptide
  XENP35122 Chain 3 - Numax Light Chain

SEQ ID NO: 2097 - protein, 449 aa, Artificial Sequence; identical to SEQ ID NO: 2073
  Description of Artificial Sequence: Synthetic polypeptide
  XENP35123 Chain 1 - Numax_VH_IgG1_pI(-)_Isosteric_A_PVA_/ S267K/L368D/K370S

SEQ ID NO: 2098 - protein, 479 aa, Artificial Sequence; identical to SEQ ID NO: 1925
  Description of Artificial Sequence: Synthetic polypeptide
  XENP35123 Chain 2 - TBRII-A[TGF-beta-RII]_H1.36_L1_scFv(GKPGS)4_ Fc(216)_IgG1_C220S/PVA_/S267K/S364K/E357Q

SEQ ID NO: 2099 - protein, 213 aa, Artificial Sequence; identical to SEQ ID NO: 2072
  Description of Artificial Sequence: Synthetic polypeptide
  XENP35123 Chain 3 - Numax Light Chain

SEQ ID NO: 2100 - protein, 449 aa, Artificial Sequence; identical to SEQ ID NO: 2073
  Description of Artificial Sequence: Synthetic polypeptide
  XENP35124 Chain 1 - Numax_VH_IgG1_pI(-)_Isosteric_A_PVA_/ S267K/L368D/K370S

SEQ ID NO: 2101 - protein, 479 aa, Artificial Sequence; identical to SEQ ID NO: 1928
  Description of Artificial Sequence: Synthetic polypeptide
  XENP35124 Chain 2 - TBRII-A[TGF-beta-RII]_H1.37_L1_scFv(GKPGS)4_ Fc(216)_IgG1_C220S/PVA_/S267K/S364K/E357Q

SEQ ID NO: 2102 - protein, 213 aa, Artificial Sequence; identical to SEQ ID NO: 2072
  Description of Artificial Sequence: Synthetic polypeptide
  XENP35124 Chain 3 - Numax Light Chain

SEQ ID NO: 2103 - protein, 449 aa, Artificial Sequence; identical to SEQ ID NO: 2073
  Description of Artificial Sequence: Synthetic polypeptide
  XENP35125 Chain 1 - Numax_VH_IgG1_pI(-)_Isosteric_A_PVA_/ S267K/L368D/K370S

SEQ ID NO: 2104 - protein, 479 aa, Artificial Sequence; identical to SEQ ID NO: 1931
  Description of Artificial Sequence: Synthetic polypeptide
  XENP35125 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2105 - protein, 213 aa, Artificial Sequence; identical to SEQ ID NO: 2072
  Description of Artificial Sequence: Synthetic polypeptide
  XENP35125 Chain 3 - Numax Light Chain

SEQ ID NO: 2106 - protein, 449 aa, Artificial Sequence; identical to SEQ ID NO: 2073
  Description of Artificial Sequence: Synthetic polypeptide
  XENP35126 Chain 1 - Numax_VH_IgG1_pI(-)_Isosteric_A_PVA_/ S267K/L368D/K370S

SEQ ID NO: 2107 - protein, 479 aa, Artificial Sequence; identical to SEQ ID NO: 1934
  Description of Artificial Sequence: Synthetic polypeptide
  XENP35126 Chain 2 - TBRII-A[TGF-beta-RII]_H1.56_L1_scFv(GKPGS)4_ Fc(216)_IgG1_C220S/PVA_/S267K/S364K/E357Q

SEQ ID NO: 2108 - protein, 213 aa, Artificial Sequence; identical to SEQ ID NO: 2072
  Description of Artificial Sequence: Synthetic polypeptide
  XENP35126 Chain 3 - Numax Light Chain

SEQ ID NO: 2109 - protein, 449 aa, Artificial Sequence; identical to SEQ ID NO: 2073
  Description of Artificial Sequence: Synthetic polypeptide
  XENP35127 Chain 1 - Numax_VH_IgG1_pI(-)_Isosteric_A_PVA_/ S267K/L368D/K370S

SEQ ID NO: 2110 - protein, 479 aa, Artificial Sequence; identical to SEQ ID NO: 1937
  Description of Artificial Sequence: Synthetic polypeptide
  XENP35127 Chain 2 - TBRII-A[TGF-beta-RII]_H1.48_L1_scFv(GKPGS)4_ Fc(216)_IgG1_C220S/PVA_/S267K/S364K/E357Q

SEQ ID NO: 2111 - protein, 213 aa, Artificial Sequence; identical to SEQ ID NO: 2072
  Description of Artificial Sequence: Synthetic polypeptide
  XENP35127 Chain 3 - Numax Light Chain

SEQ ID NO: 2112 - protein, 449 aa, Artificial Sequence; identical to SEQ ID NO: 2073
  Description of Artificial Sequence: Synthetic polypeptide
  XENP35128 Chain 1 - Numax_VH_IgG1_pI(-)_Isosteric_A_PVA_/ S267K/L368D/K370S

SEQ ID NO: 2113 - protein, 479 aa, Artificial Sequence; identical to SEQ ID NO: 1940
  Description of Artificial Sequence: Synthetic polypeptide
  XENP35128 Chain 2 - TBRII-A[TGF-beta-RII]_H1.50_L1_scFv(GKPGS)4_ Fc(216)_IgG1_C220S/PVA_/S267K/S364K/E357Q

SEQ ID NO: 2114 - protein, 213 aa, Artificial Sequence; identical to SEQ ID NO: 2072
  Description of Artificial Sequence: Synthetic polypeptide
  XENP35128 Chain 3 - Numax Light Chain

SEQ ID NO: 2115 - protein, 449 aa, Artificial Sequence; identical to SEQ ID NO: 2073
  Description of Artificial Sequence: Synthetic polypeptide
  XENP35379 Chain 1 - Numax_VH_IgG1_pI(-)_Isosteric_A_PVA_/ S267K/L368D/K370S

SEQ ID NO: 2116 - protein, 479 aa, Artificial Sequence; identical to SEQ ID NO: 1943
  Description of Artificial Sequence: Synthetic polypeptide
  XENP35379 Chain 2 - TBRII-A[TGF RII]_L1_H1.1_scFv(GKPGS)4_Fc(216)_ IgG1_C220S/PVA_/S267K/S364K/E357Q

SEQ ID NO: 2117 - protein, 213 aa, Artificial Sequence; identical to SEQ ID NO: 2072
  Description of Artificial Sequence: Synthetic polypeptide
  XENP35379 Chain 3 - Numax Light Chain

SEQ ID NO: 2118 - protein, 449 aa, Artificial Sequence; identical to SEQ ID NO: 2073
  Description of Artificial Sequence: Synthetic polypeptide
  XENP36979 Chain 1 - Numax_IgG1_pI(-)_Isosteric_A_PVA_/ S267K/L368D/K370S

SEQ ID NO: 2119 - protein, 479 aa, Artificial Sequence; identical to SEQ ID NO: 2003
  Description of Artificial Sequence: Synthetic polypeptide
  XENP36979 Chain 2 - TBRII-A[TGF RII]_H1.189_L1_scFv(GKPGS)4_ Fc(216_IgG1_C220S/PVA_/S267K/S364K/E357Q

SEQ ID NO: 2120 - protein, 213 aa, Artificial Sequence; identical to SEQ ID NO: 2072
  Description of Artificial Sequence: Synthetic polypeptide
  XENP36979 Chain 3 - Numax Light Chain

SEQ ID NO: 2121 - protein, 449 aa, Artificial Sequence; identical to SEQ ID NO: 2073
  Description of Artificial Sequence: Synthetic polypeptide
  XENP36980 Chain 1 - Numax_IgG1_pI(-)_Isosteric_A_PVA_/ S267K/L368D/K370S

SEQ ID NO: 2122 - protein, 479 aa, Artificial Sequence; identical to SEQ ID NO: 2006
  Description of Artificial Sequence: Synthetic polypeptide
  XENP36980 Chain 2 - TBRII-A[TGF RII]_H1.190_L1_scFv(GKPGS)4_ Fc(216_IgG1_C220S/PVA_/S267K/S364K/E357Q

SEQ ID NO: 2123 - protein, 213 aa, Artificial Sequence; identical to SEQ ID NO: 2072
  Description of Artificial Sequence: Synthetic polypeptide
  XENP36980 Chain 3 - Numax Light Chain

SEQ ID NO: 2124 - protein, 449 aa, Artificial Sequence; identical to SEQ ID NO: 2073
  Description of Artificial Sequence: Synthetic polypeptide
  XENP36981 Chain 1 - Numax_IgG1_pI(-)_Isosteric_A_PVA_/ S267K/L368D/K370S

SEQ ID NO: 2125 - protein, 479 aa, Artificial Sequence; identical to SEQ ID NO: 2039
  Description of Artificial Sequence: Synthetic polypeptide
  XENP36981 Chain 2 - TBRII-A[TGF RII]_H1.201_L1_scFv(GKPGS)4_ Fc(216_IgG1_C220S/PVA_/S267K/S364K/E357Q

SEQ ID NO: 2126 - protein, 213 aa, Artificial Sequence; identical to SEQ ID NO: 2072
  Description of Artificial Sequence: Synthetic polypeptide
  XENP36981 Chain 3 - Numax Light Chain

SEQ ID NO: 2127 - protein, 449 aa, Artificial Sequence
  Description of Artificial Sequence: Synthetic polypeptide
  XENP36982 Chain 1 - 5D7[CD5]_H1IgG1_pI(-)_Isosteric_A_PVA_/ S267K/L368D/K370S
EVQLVESGGGVVQPGRSLRLSCTFSGFSLSTSGMGVGWIRQAPGKGLEWVAHIWWDDDVYYNPSLKSRLTITKDASTDTVYMELSSLRSEDTAVYYCVRRRATGTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2128 - protein, 479 aa, Artificial Sequence; identical to SEQ ID NO: 2003
  Description of Artificial Sequence: Synthetic polypeptide
  XENP36982 Chain 2 - TBRII-A[TGF RII]_H1.189_L1_scFv(GKPGS)4_ Fc(216_IgG1_C220S/PVA_/S267K/S364K/E357Q

SEQ ID NO: 2129 - protein, 213 aa, Artificial Sequence
  Description of Artificial Sequence: Synthetic polypeptide
  XENP36982 Chain 3 - 5D7[CD5]_L1 Light Chain
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2130 - protein, 449 aa, Artificial Sequence; identical to SEQ ID NO: 2073
  Description of Artificial Sequence: Synthetic polypeptide
  XENP39137 Chain 1 - Numax_VH_IgG1_pI(-)_Isosteric_A_/PVA_/ S267K/L368D/K370S

SEQ ID NO: 2131 - protein, 479 aa, Artificial Sequence
  Description of Artificial Sequence: Synthetic polypeptide
  XENP39137 Chain 2 - TBRII-A[TGF RII]_H1.212_L1_scFv(GKPGS)4_ Fc(216_IgG1_C220S/PVA_/S267K/S364K/E357Q
QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2132 - protein, 213 aa, Artificial Sequence; identical to SEQ ID NO: 2072
  Description of Artificial Sequence: Synthetic polypeptide
  XENP39137 Chain 3 - Numax Light Chain

SEQ ID NO: 2133 - protein, 495 aa, Homo sapiens
  sp|P06127 Human CD5 sequence
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 2134 - protein, 348 aa, Homo sapiens
  sp|P06127|25-372 Human CD5 sequence, extracellular domain
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 2135 - protein, 499 aa, Macaca fascicularis
  tr|G7PPY7 Macaca fascicularis CD5 sequence
MPMGSPQPLATLYLLGMLVASCLGRLSWDDPDFQTRLTRSNSRCQGQLEVYIKYGWHMVCSQSWGRSSNQWEDPNQASKVCQRLNCGVPLSLGPFLITDRHQSQITCYGRLGSFSNCSHSGRDVCRPLGLTCLEPQTTTPPPTRPPPTTTPEPTAPPRLQLVAQAAGRHCAGVVEFYSGSLGGTISYEAQDKAQDKTQVLENFLCSSLQCGSFLKHLPETEAATAQDPGELREHQPLPIQWTIRNSSCTSLEHCFRKIKPRNSGQVLALLCSGFQPKVQSRLVGGSSICEGTVEVRQGAQWAALCDSSSAKSSLRWEEVCREQQCGSFNSYQALDAGDPTSRGLSCPHQKLSQCHELTERKSYCKKVFVTCQDPNPAGPAAGTVASIILALVLLGVLLVVCGPLAYKKLVKKFRQKKQRQWIGPTGMNQNMSFHRNHTATVRSHVENPTASHVDNEYSQPPRNSRLSAYPALEGALHRSSTQPDNSSDSDYDLHGAQRL

SEQ ID NO: 2136 - protein, 352 aa, Macaca fascicularis
  tr|G7PPY7|25-376 Macaca fascicularis CD5 sequence, extracellular domain (predicted)
RLSWDDPDFQTRLTRSNSRCQGQLEVYIKYGWHMVCSQSWGRSSNQWEDPNQASKVCQRLNCGVPLSLGPFLITDRHQSQITCYGRLGSFSNCSHSGRDVCRPLGLTCLEPQTTTPPPTRPPPTTTPEPTAPPRLQLVAQAAGRHCAGVVEFYSGSLGGTISYEAQDKAQDKTQVLENFLCSSLQCGSFLKHLPETEAATAQDPGELREHQPLPIQWTIRNSSCTSLEHCFRKIKPRNSGQVLALLCSGFQPKVQSRLVGGSSICEGTVEVRQGAQWAALCDSSSAKSSLRWEEVCREQQCGSFNSYQALDAGDPTSRGLSCPHQKLSQCHELTERKSYCKKVFVTCQDPNP

SEQ ID NO: 2137 - protein, 120 aa, Artificial Sequence
  Description of Artificial Sequence: Synthetic polypeptide
  5D7[CD5]_H1L1 Variable heavy (vh) domain
EVQLVESGGGVVQPGRSLRLSCTFSGFSLSTSGMGVGWIRQAPGKGLEWVAHIWWDDDVYYNPSLKSRLTITKDASTDTVYMELSSLRSEDTAVYYCVRRRATGTGFDYWGQGTLVTVSS

SEQ ID NO: 2138 - protein, 7 aa, Artificial Sequence
  Description of Artificial Sequence: Synthetic peptide
  5D7[CD5]_H1L1 vhCDR1
TSGMGVG

SEQ ID NO: 2139 - protein, 16 aa, Artificial Sequence
  Description of Artificial Sequence: Synthetic peptide
  5D7[CD5]_H1L1 vhCDR2
HIWWDDDVYYNPSLKS

SEQ ID NO: 2140 - protein, 10 aa, Artificial Sequence
  Description of Artificial Sequence: Synthetic peptide
  5D7[CD5]_H1L1 vhCDR3
RRATGTGFDY

SEQ ID NO: 2141 - protein, 106 aa, Artificial Sequence; identical to SEQ ID NO: 5
  Description of Artificial Sequence: Synthetic polypeptide
  5D7[CD5]_H1L1 Variable light (vl) domain

SEQ ID NO: 2142 - protein, 11 aa, Artificial Sequence
  Description of Artificial Sequence: Synthetic peptide
  5D7[CD5]_H1L1 vlCDR1
QASQDVGTAVA

SEQ ID NO: 2143 - protein, 7 aa, Artificial Sequence
  Description of Artificial Sequence: Synthetic peptide
  5D7[CD5]_H1L1 vlCDR2
WTSTRHT

SEQ ID NO: 2144 - protein, 8 aa, Artificial Sequence
  Description of Artificial Sequence: Synthetic peptide
  5D7[CD5]_H1L1 vlCDR3
HQYNSYNT

SEQ ID NO: 2145 - protein, 449 aa, Artificial Sequence
  Description of Artificial Sequence: Synthetic polypeptide
  XENP35401 Heavy Chain -  5D7[CD5]_H1L1_IgG1_PVA_/S267K
EVQLVESGGGVVQPGRSLRLSCTFSGFSLSTSGMGVGWIRQAPGKGLEWVAHIWWDDDVYYNPSLKSRLTITKDASTDTVYMELSSLRSEDTAVYYCVRRRATGTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2146 - protein, 213 aa, Artificial Sequence; identical to SEQ ID NO: 2129
  Description of Artificial Sequence: Synthetic polypeptide
  XENP35401 Light Chain -  5D7[CD5]_H1L1_IgG1_PVA_/S267K

SEQ ID NO: 2147 - protein, 119 aa, Artificial Sequence
  Description of Artificial Sequence: Synthetic polypeptide
  Cd5-A[CD5]_H0L0 Variable heavy (vh) domain
EVQLKESGAELVRPGGSVKISCKGSGYTFTNFAIHWVKQSHIKTLEWIGLISTSSGDVSYNQKFKDKATMTVDKSSSTAYMELARLTSEDSAIYYCARHYGANNYFDYWGQGTLVTVSS

SEQ ID NO: 2148 - protein, 5 aa, Artificial Sequence
  Description of Artificial Sequence: Synthetic peptide
  Cd5-A[CD5]_H0L0 vhCDR1
NFAIH

SEQ ID NO: 2149 - protein, 17 aa, Artificial Sequence
  Description of Artificial Sequence: Synthetic peptide
  Cd5-A[CD5]_H0L0 vhCDR2
LISTSSGDVSYNQKFKD

SEQ ID NO: 2150 - protein, 10 aa, Artificial Sequence
  Description of Artificial Sequence: Synthetic peptide
  Cd5-A[CD5]_H0L0 vhCDR3
HYGANNYFDY

SEQ ID NO: 2151 - protein, 108 aa, Artificial Sequence
  Description of Artificial Sequence: Synthetic polypeptide
  Cd5-A[CD5]_H0L0 Variable light (vl) domain
EIVLTQSPTIMSASPGEQVTMTCRTNSSVSSSYLHWYQQKSGASPKLWIYGTSNLASGVPTRFSGSGSGTSYSLTISSVEAGDAATYFCQQYSGYPLTFGGGTKVEIK

SEQ ID NO: 2152 - protein, 12 aa, Artificial Sequence
  Description of Artificial Sequence: Synthetic peptide
  Cd5-A[CD5]_H0L0 vlCDR1
RTNSSVSSSYLH

SEQ ID NO: 2153 - protein, 7 aa, Artificial Sequence
  Description of Artificial Sequence: Synthetic peptide
  Cd5-A[CD5]_H0L0 vlCDR2
GTSNLAS

SEQ ID NO: 2154 - protein, 9 aa, Artificial Sequence
  Description of Artificial Sequence: Synthetic peptide
  Cd5-A[CD5]_H0L0 vlCDR3
QQYSGYPLT

SEQ ID NO: 2155 - protein, 119 aa, Artificial Sequence
  Description of Artificial Sequence: Synthetic polypeptide
  Cd5-A[CD5]_H1L1 - Humanized Variable heavy (vh) domain
QVQLVQSGAEVKKPGASVKVSCKGSGYTFTNFAIHWVRQAPGQTLEWMGLISTSSGDVSYNQKFQGRVTMTVDKSTSTAYMELSSLRSEDTAVYYCARHYGANNYFDYWGQGTLVTVSS

SEQ ID NO: 2156 - protein, 5 aa, Artificial Sequence
  Description of Artificial Sequence: Synthetic peptide
  Cd5-A[CD5]_H1L1 - Humanized vhCDR1
NFAIH

SEQ ID NO: 2157 - protein, 17 aa, Artificial Sequence
  Description of Artificial Sequence: Synthetic peptide
  Cd5-A[CD5]_H1L1 - Humanized vhCDR2
LISTSSGDVSYNQKFQG

SEQ ID NO: 2158 - protein, 10 aa, Artificial Sequence
  Description of Artificial Sequence: Synthetic peptide
  Cd5-A[CD5]_H1L1 - Humanized vhCDR3
HYGANNYFDY

SEQ ID NO: 2159 - protein, 108 aa, Artificial Sequence
  Description of Artificial Sequence: Synthetic polypeptide
  Cd5-A[CD5]_H1L1 - Humanized Variable light (vl) domain
EIVLTQSPGTLSLSPGERATLSCRTNSSVSSSYLHWYQQKPGQSPRLLIYGTSNLASGVPTRFSGSGSGTDYTLTISRLEPEDFAVYFCQQYSGYPLTFGGGTKVEIK

SEQ ID NO: 2160 - protein, 12 aa, Artificial Sequence
  Description of Artificial Sequence: Synthetic peptide
  Cd5-A[CD5]_H1L1 - Humanized vlCDR1
RTNSSVSSSYLH

SEQ ID NO: 2161 - protein, 7 aa, Artificial Sequence
  Description of Artificial Sequence: Synthetic peptide
  Cd5-A[CD5]_H1L1 - Humanized vlCDR2
GTSNLAS

SEQ ID NO: 2162 - protein, 9 aa, Artificial Sequence
  Description of Artificial Sequence: Synthetic peptide
  Cd5-A[CD5]_H1L1 - Humanized vlCDR3
QQYSGYPLT

SEQ ID NO: 2163 - protein, 119 aa, Artificial Sequence; identical to SEQ ID NO: 1704
  Description of Artificial Sequence: Synthetic polypeptide
  Cd5-B[CD5]_H0L0 - Murine Variable heavy (vh) domain

SEQ ID NO: 2164 - protein, 5 aa, Artificial Sequence
  Description of Artificial Sequence: Synthetic peptide
  Cd5-B[CD5]_H0L0 - Murine vhCDR1
SYWMN

SEQ ID NO: 2165 - protein, 17 aa, Artificial Sequence
  Description of Artificial Sequence: Synthetic peptide
  Cd5-B[CD5]_H0L0 - Murine vhCDR2
MIHPSDSETRLNQKFKD

SEQ ID NO: 2166 - protein, 10 aa, Artificial Sequence
  Description of Artificial Sequence: Synthetic peptide
  Cd5-B[CD5]_H0L0 - Murine vhCDR3
WGDHDDAMDF

SEQ ID NO: 2167 - protein, 107 aa, Artificial Sequence; identical to SEQ ID NO: 1755
  Description of Artificial Sequence: Synthetic polypeptide
  Cd5-B[CD5]_H0L0 - Murine Variable light (vl) domain

SEQ ID NO: 2168 - protein, 11 aa, Artificial Sequence
  Description of Artificial Sequence: Synthetic peptide
  Cd5-B[CD5]_H0L0 - Murine vlCDR1
RPSENIYGYFA

SEQ ID NO: 2169 - protein, 7 aa, Artificial Sequence
  Description of Artificial Sequence: Synthetic peptide
  Cd5-B[CD5]_H0L0 - Murine vlCDR2
NAKTLAE

SEQ ID NO: 2170 - protein, 9 aa, Artificial Sequence
  Description of Artificial Sequence: Synthetic peptide
  Cd5-B[CD5]_H0L0 - Murine vlCDR3
QHHYGTPFT

SEQ ID NO: 2171 - protein, 119 aa, Artificial Sequence; identical to SEQ ID NO: 1705
  Description of Artificial Sequence: Synthetic polypeptide
  Cd5-B[CD5]_H1L1 - Humanized Variable heavy (vh) domain

SEQ ID NO: 2172 - protein, 5 aa, Artificial Sequence
  Description of Artificial Sequence: Synthetic peptide
  Cd5-B[CD5]_H1L1 - Humanized vhCDR1
SYWMN

SEQ ID NO: 2173 - protein, 17 aa, Artificial Sequence
  Description of Artificial Sequence: Synthetic peptide
  Cd5-B[CD5]_H1L1 - Humanized vhCDR2
MIHPSDSETRYNQSFQG

SEQ ID NO: 2174 - protein, 10 aa, Artificial Sequence
  Description of Artificial Sequence: Synthetic peptide
  Cd5-B[CD5]_H1L1 - Humanized vhCDR3
WGDHDDAMDF

SEQ ID NO: 2175 - protein, 107 aa, Artificial Sequence; identical to SEQ ID NO: 1756
  Description of Artificial Sequence: Synthetic polypeptide
  Cd5-B[CD5]_H1L1 - Humanized Variable light (vl) domain

SEQ ID NO: 2176 - protein, 11 aa, Artificial Sequence
  Description of Artificial Sequence: Synthetic peptide
  Cd5-B[CD5]_H1L1 - Humanized vlCDR1
RPSENIYGYFA

SEQ ID NO: 2177 - protein, 7 aa, Artificial Sequence
  Description of Artificial Sequence: Synthetic peptide
  Cd5-B[CD5]_H1L1 - Humanized vlCDR2
NAKTLAE

SEQ ID NO: 2178 - protein, 9 aa, Artificial Sequence
  Description of Artificial Sequence: Synthetic peptide
  Cd5-B[CD5]_H1L1 - Humanized vlCDR3
QHHYGTPFT

SEQ ID NO: 2179 - protein, 119 aa, Artificial Sequence; identical to SEQ ID NO: 1728
  Description of Artificial Sequence: Synthetic polypeptide
  Cd5-B[CD5]_Affinity-Repaired Cd5-B VH - H1.23 Variable heavy (vh) domain

SEQ ID NO: 2180 - protein, 5 aa, Artificial Sequence
  Description of Artificial Sequence: Synthetic peptide
  Cd5-B[CD5]_Affinity-Repaired Cd5-B VH - H1.23 vhCDR1
SYWMN

SEQ ID NO: 2181 - protein, 17 aa, Artificial Sequence
  Description of Artificial Sequence: Synthetic peptide
  Cd5-B[CD5]_Affinity-Repaired Cd5-B VH - H1.23 vhCDR2
MIYPSDSETRYNQSFQG

SEQ ID NO: 2182 - protein, 10 aa, Artificial Sequence
  Description of Artificial Sequence: Synthetic peptide
  Cd5-B[CD5]_Affinity-Repaired Cd5-B VH - H1.23 vhCDR3
WGDHDDAMDF

SEQ ID NO: 2183 - protein, 119 aa, Artificial Sequence; identical to SEQ ID NO: 1741
  Description of Artificial Sequence: Synthetic polypeptide
  Cd5-B[CD5]_Affinity-Repaired Cd5-B VH - H1.36 Variable heavy (vh) domain

SEQ ID NO: 2184 - protein, 5 aa, Artificial Sequence
  Description of Artificial Sequence: Synthetic peptide
  Cd5-B[CD5]_Affinity-Repaired Cd5-B VH - H1.36 vhCDR1
SYWMN

SEQ ID NO: 2185 - protein, 17 aa, Artificial Sequence
  Description of Artificial Sequence: Synthetic peptide
  Cd5-B[CD5]_Affinity-Repaired Cd5-B VH - H1.36 vhCDR2
MIHPSDSETRYNQKFQG

SEQ ID NO: 2186 - protein, 10 aa, Artificial Sequence
  Description of Artificial Sequence: Synthetic peptide
  Cd5-B[CD5]_Affinity-Repaired Cd5-B VH - H1.36 vhCDR3
WGDHDDAMDF

SEQ ID NO: 2187 - protein, 119 aa, Artificial Sequence; identical to SEQ ID NO: 1754
  Description of Artificial Sequence: Synthetic polypeptide
  Cd5-B[CD5]_Affinity-Repaired Cd5-B VH - H2 Variable heavy (vh) domain

SEQ ID NO: 2188 - protein, 5 aa, Artificial Sequence
  Description of Artificial Sequence: Synthetic peptide
  Cd5-B[CD5]_Affinity-Repaired Cd5-B VH - H2 vhCDR1
SYWMN

SEQ ID NO: 2189 - protein, 17 aa, Artificial Sequence
  Description of Artificial Sequence: Synthetic peptide
  Cd5-B[CD5]_Affinity-Repaired Cd5-B VH - H2 vhCDR2
MIHPSDSETRYNQKFQG

SEQ ID NO: 2190 - protein, 10 aa, Artificial Sequence
  Description of Artificial Sequence: Synthetic peptide
  Cd5-B[CD5]_Affinity-Repaired Cd5-B VH - H2 vhCDR3
WGDHDDAMDF

SEQ ID NO: 2191 - protein, 107 aa, Artificial Sequence; identical to SEQ ID NO: 1757
  Description of Artificial Sequence: Synthetic polypeptide
  Cd5-B[CD5]_Affinity-Repaired Cd5-B VL - L2 Variable light (vl) domain

SEQ ID NO: 2192 - protein, 11 aa, Artificial Sequence
  Description of Artificial Sequence: Synthetic peptide
  Cd5-B[CD5]_Affinity-Repaired Cd5-B VL - L2 vlCDR1
KPSENIYGYFA

SEQ ID NO: 2193 - protein, 7 aa, Artificial Sequence
  Description of Artificial Sequence: Synthetic peptide
  Cd5-B[CD5]_Affinity-Repaired Cd5-B VL - L2 vlCDR2
NAKTLAE

SEQ ID NO: 2194 - protein, 9 aa, Artificial Sequence
  Description of Artificial Sequence: Synthetic peptide
  Cd5-B[CD5]_Affinity-Repaired Cd5-B VL - L2 vlCDR3
QHHYGTPFT

SEQ ID NO: 2195 - protein, 449 aa, Artificial Sequence; identical to SEQ ID NO: 2127
  Description of Artificial Sequence: Synthetic polypeptide
  XENP35399 Chain 1 -  5D7[CD5]_H1L1_Fab_IgG1_pI(-)_Isosteric_A_ /PVA_/S267K/L368D/K370S

SEQ ID NO: 2196 - protein, 479 aa, Artificial Sequence; identical to SEQ ID NO: 1907
  Description of Artificial Sequence: Synthetic polypeptide
  XENP35399 Chain 2 -  TBRII-A[TGF-beta-RII]_H1.1_L1_scFv(GKPGS)4_ Fc(216)_IgG1_C220S/PVA_/S267K/S364K/E357Q

SEQ ID NO: 2197 - protein, 213 aa, Artificial Sequence; identical to SEQ ID NO: 2129
  Description of Artificial Sequence: Synthetic polypeptide
  XENP35399 Chain 3 -  5D7[CD5]_L1

SEQ ID NO: 2198 - protein, 449 aa, Artificial Sequence; identical to SEQ ID NO: 2127
  Description of Artificial Sequence: Synthetic polypeptide
  XENP36132 Chain 1 -  5D7[CD5]_H1L1_Fab_IgG1_pI(-)_Isosteric_A_ /PVA_/S267K/L368D/K370S

SEQ ID NO: 2199 - protein, 479 aa, Artificial Sequence; identical to SEQ ID NO: 1919
  Description of Artificial Sequence: Synthetic polypeptide
  XENP36132 Chain 2 -  TBRII-A[TGF-beta-RII]_H1.30_L1_scFv(GKPGS)4 _Fc(216)_IgG1_C220S/PVA_/S267K/S364K/E357Q

SEQ ID NO: 2200 - protein, 213 aa, Artificial Sequence; identical to SEQ ID NO: 2129
  Description of Artificial Sequence: Synthetic polypeptide
  XENP36132 Chain 3 -  5D7[CD5]_L1

SEQ ID NO: 2201 - protein, 449 aa, Artificial Sequence; identical to SEQ ID NO: 2127
  Description of Artificial Sequence: Synthetic polypeptide
  XENP36983 Chain 1 - 5D7[CD5]_H1IgG1_pI(-)_Isosteric_A_PVA_/ S267K/L368D/K370S

SEQ ID NO: 2202 - protein, 479 aa, Artificial Sequence; identical to SEQ ID NO: 2006
  Description of Artificial Sequence: Synthetic polypeptide
  XENP36983 Chain 2 - TBRII-A[TGF RII]_H1.190_L1_scFv(GKPGS)4_ Fc(216_IgG1_C220S/PVA_/S267K/S364K/E357Q

SEQ ID NO: 2203 - protein, 213 aa, Artificial Sequence; identical to SEQ ID NO: 2129
  Description of Artificial Sequence: Synthetic polypeptide
  XENP36983 Chain 3 - 5D7[CD5]_L1 Light Chain

SEQ ID NO: 2204 - protein, 449 aa, Artificial Sequence; identical to SEQ ID NO: 2127
  Description of Artificial Sequence: Synthetic polypeptide
  XENP36984 Chain 1 - 5D7[CD5]_H1IgG1_pI(-)_Isosteric_A_PVA_/ S267K/L368D/K370S

SEQ ID NO: 2205 - protein, 479 aa, Artificial Sequence; identical to SEQ ID NO: 2039
  Description of Artificial Sequence: Synthetic polypeptide
  XENP36984 Chain 2 - TBRII-A[TGF RII]_H1.201_L1_scFv(GKPGS)4_ Fc(216_IgG1_C220S/PVA_/S267K/S364K/E357Q

SEQ ID NO: 2206 - protein, 213 aa, Artificial Sequence; identical to SEQ ID NO: 2129
  Description of Artificial Sequence: Synthetic polypeptide
  XENP36984 Chain 3 - 5D7[CD5]_L1 Light Chain

SEQ ID NO: 2207 - protein, 449 aa, Artificial Sequence; identical to SEQ ID NO: 2127
  Description of Artificial Sequence: Synthetic polypeptide
  XENP37314 Chain 1 - 5D7[CD5]_H1_IgG1_pI(-)_Isosteric_A_/PVA_/ S267K/L368D/K370S

SEQ ID NO: 2208 - protein, 479 aa, Artificial Sequence
  Description of Artificial Sequence: Synthetic polypeptide
  XENP37314 Chain 2 - TBRII-A[TGF-beta-RII]_H1.204_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTAIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2209 - protein, 213 aa, Artificial Sequence; identical to SEQ ID NO: 2129
  Description of Artificial Sequence: Synthetic polypeptide
  XENP37314 Chain 3 - 5D7[CD5]_L1 Light Chain

SEQ ID NO: 2210 - protein, 449 aa, Artificial Sequence; identical to SEQ ID NO: 2127
  Description of Artificial Sequence: Synthetic polypeptide
  XENP37315 Chain 1 - 5D7[CD5]_H1_IgG1_pI(-)_Isosteric_A_/PVA_/ S267K/L368D/K370S

SEQ ID NO: 2211 - protein, 479 aa, Artificial Sequence
  Description of Artificial Sequence: Synthetic polypeptide
  XENP37315 Chain 2 - TBRII-A[TGF-beta-RII]_H1.205_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTIIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2212 - protein, 213 aa, Artificial Sequence; identical to SEQ ID NO: 2129
  Description of Artificial Sequence: Synthetic polypeptide
  XENP37315 Chain 3 - 5D7[CD5]_L1 Light Chain

SEQ ID NO: 2213 - protein, 449 aa, Artificial Sequence; identical to SEQ ID NO: 2127
  Description of Artificial Sequence: Synthetic polypeptide
  XENP37316 Chain 1 - 5D7[CD5]_H1_IgG1_pI(-)_Isosteric_A_/PVA_/ S267K/L368D/K370S

SEQ ID NO: 2214 - protein, 479 aa, Artificial Sequence
  Description of Artificial Sequence: Synthetic polypeptide
  XENP37316 Chain 2 - TBRII-A[TGF-beta-RII]_H1.206_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTSIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2215 - protein, 213 aa, Artificial Sequence; identical to SEQ ID NO: 2129
  Description of Artificial Sequence: Synthetic polypeptide
  XENP37316 Chain 3 - 5D7[CD5]_L1 Light Chain

SEQ ID NO: 2216 - protein, 449 aa, Artificial Sequence; identical to SEQ ID NO: 2127
  Description of Artificial Sequence: Synthetic polypeptide
  XENP37317 Chain 1 - 5D7[CD5]_H1_IgG1_pI(-)_Isosteric_A_/PVA_/ S267K/L368D/K370S

SEQ ID NO: 2217 - protein, 479 aa, Artificial Sequence
  Description of Artificial Sequence: Synthetic polypeptide
  XENP37317 Chain 2 - TBRII-A[TGF-beta-RII]_H1.207_L1_scFv(GKPGS)4 _Fc(216)_IgG1_C220S/PVA_/S267K/S364K/E357Q
QLQVQESGPGLVKPSETLSLTCTVSGGSISSSYFTWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2218 - protein, 213 aa, Artificial Sequence; identical to SEQ ID NO: 2129
  Description of Artificial Sequence: Synthetic polypeptide
  XENP37317 Chain 3 - 5D7[CD5]_L1 Light Chain

SEQ ID NO: 2219 - protein, 449 aa, Artificial Sequence; identical to SEQ ID NO: 2127
  Description of Artificial Sequence: Synthetic polypeptide
  XENP37318 Chain 1 - 5D7[CD5]_H1_IgG1_pI(-)_Isosteric_A_/PVA_/ S267K/L368D/K370S

SEQ ID NO: 2220 - protein, 479 aa, Artificial Sequence
  Description of Artificial Sequence: Synthetic polypeptide
  XENP37318 Chain 2 - TBRII-A[TGF-beta-RII]_H1.208_L1_scFv(GKPGS)4 _Fc(216)_IgG1_C220S/PVA_/S267K/S364K/E357Q
QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2221 - protein, 213 aa, Artificial Sequence; identical to SEQ ID NO: 2129
  Description of Artificial Sequence: Synthetic polypeptide
  XENP37318 Chain 3 - 5D7[CD5]_L1 Light Chain

SEQ ID NO: 2222 - protein, 449 aa, Artificial Sequence; identical to SEQ ID NO: 2127
  Description of Artificial Sequence: Synthetic polypeptide
  XENP37319 Chain 1 - 5D7[CD5]_H1_IgG1_pI(-)_Isosteric_A_/PVA_/ S267K/L368D/K370S

SEQ ID NO: 2223 - protein, 479 aa, Artificial Sequence
  Description of Artificial Sequence: Synthetic polypeptide
  XENP37319 Chain 2 - TBRII-A[TGF-beta-RII]_H1.209_L1_scFv(GKPGS)4 _Fc(216)_IgG1_C220S/PVA_/S267K/S364K/E357Q
QLQVQESGPGLVKPSETLSLTCTVSGGSISSSYFYWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2224 - protein, 213 aa, Artificial Sequence; identical to SEQ ID NO: 2129
  Description of Artificial Sequence: Synthetic polypeptide
  XENP37319 Chain 3 - 5D7[CD5]_L1 Light Chain

SEQ ID NO: 2225 - protein, 449 aa, Artificial Sequence; identical to SEQ ID NO: 2127
  Description of Artificial Sequence: Synthetic polypeptide
  XENP37320 Chain 1 - 5D7[CD5]_H1_IgG1_pI(-)_Isosteric_A_/PVA_/ S267K/L368D/K370S

SEQ ID NO: 2226 - protein, 479 aa, Artificial Sequence
  Description of Artificial Sequence: Synthetic polypeptide
  XENP37320 Chain 2 - TBRII-A[TGF-beta-RII]_H1.210_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTLIRGVFDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2227 - protein, 213 aa, Artificial Sequence; identical to SEQ ID NO: 2129
  Description of Artificial Sequence: Synthetic polypeptide
  XENP37320 Chain 3 - 5D7[CD5]_L1 Light Chain

SEQ ID NO: 2228 - protein, 449 aa, Artificial Sequence; identical to SEQ ID NO: 2127
  Description of Artificial Sequence: Synthetic polypeptide
  XENP37321 Chain 1 - 5D7[CD5]_H1_IgG1_pI(-)_Isosteric_A_/PVA_/ S267K/L368D/K370S

SEQ ID NO: 2229 - protein, 479 aa, Artificial Sequence
  Description of Artificial Sequence: Synthetic polypeptide
  XENP37321 Chain 2 - TBRII-A[TGF-beta-RII]_H1.211_L1_scFv(GKPGS)4 _Fc(216)_IgG1_C220S/PVA_/S267K/S364K/E357Q
QLQVQESGPGLVKPSETLSLTCTVSGGSISSSYFTWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2230 - protein, 213 aa, Artificial Sequence; identical to SEQ ID NO: 2129
  Description of Artificial Sequence: Synthetic polypeptide
  XENP37321 Chain 3 - 5D7[CD5]_L1 Light Chain

SEQ ID NO: 2231 - protein, 449 aa, Artificial Sequence; identical to SEQ ID NO: 2127
  Description of Artificial Sequence: Synthetic polypeptide
  XENP37322 Chain 1 - 5D7[CD5]_H1_IgG1_pI(-)_Isosteric_A_/PVA_/ S267K/L368D/K370S

SEQ ID NO: 2232 - protein, 479 aa, Artificial Sequence; identical to SEQ ID NO: 2131
  Description of Artificial Sequence: Synthetic polypeptide
  XENP37322 Chain 2 - TBRII-A[TGF-beta-RII]_H1.212_L1_scFv(GKPGS)4 _Fc(216)_IgG1_C220S/PVA_/S267K/S364K/E357Q

SEQ ID NO: 2233 - protein, 213 aa, Artificial Sequence; identical to SEQ ID NO: 2129
  Description of Artificial Sequence: Synthetic polypeptide
  XENP37322 Chain 3 - 5D7[CD5]_L1 Light Chain

SEQ ID NO: 2234 - protein, 449 aa, Artificial Sequence; identical to SEQ ID NO: 2127
  Description of Artificial Sequence: Synthetic polypeptide
  XENP37323 Chain 1 - 5D7[CD5]_H1_IgG1_pI(-)_Isosteric_A_/PVA_/ S267K/L368D/K370S

SEQ ID NO: 2235 - protein, 479 aa, Artificial Sequence
  Description of Artificial Sequence: Synthetic polypeptide
  XENP37323 Chain 2 - TBRII-A[TGF-beta-RII]_H1.213_L1_scFv(GKPGS)4 _Fc(216)_IgG1_C220S/PVA_/S267K/S364K/E357Q
QLQVQESGPGLVKPSETLSLTCTVSGGSISSSYFYWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2236 - protein, 213 aa, Artificial Sequence; identical to SEQ ID NO: 2129
  Description of Artificial Sequence: Synthetic polypeptide
  XENP37323 Chain 3 - 5D7[CD5]_L1 Light Chain

SEQ ID NO: 2237 - protein, 449 aa, Artificial Sequence; identical to SEQ ID NO: 2127
  Description of Artificial Sequence: Synthetic polypeptide
  XENP37324 Chain 1 - 5D7[CD5]_H1_IgG1_pI(-)_Isosteric_A_/PVA_/ S267K/L368D/K370S

SEQ ID NO: 2238 - protein, 479 aa, Artificial Sequence
  Description of Artificial Sequence: Synthetic polypeptide
  XENP37324 Chain 2 - TBRII-A[TGF-beta-RII]_H1.214_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTTIRGVFDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2239 - protein, 213 aa, Artificial Sequence; identical to SEQ ID NO: 2129
  Description of Artificial Sequence: Synthetic polypeptide
  XENP37324 Chain 3 - 5D7[CD5]_L1 Light Chain

SEQ ID NO: 2240 - protein, 449 aa, Artificial Sequence; identical to SEQ ID NO: 2127
  Description of Artificial Sequence: Synthetic polypeptide
  XENP37379 Chain 1 - 5D7[CD5]_H1_IgG1_pI(-)_Isosteric_A_PVA_/ S267K/L368D/K370S

SEQ ID NO: 2241 - protein, 479 aa, Artificial Sequence; identical to SEQ ID NO: 1931
  Description of Artificial Sequence: Synthetic polypeptide
  XENP37379 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2242 - protein, 213 aa, Artificial Sequence; identical to SEQ ID NO: 2129
  Description of Artificial Sequence: Synthetic polypeptide
  XENP37379 Chain 3 - 5D7[CD5]_L1 Light Chain

SEQ ID NO: 2243 - protein, 449 aa, Artificial Sequence; identical to SEQ ID NO: 2127
  Description of Artificial Sequence: Synthetic polypeptide
  XENP37380 Chain 1 - 5D7[CD5]_H1_IgG1_pI(-)_Isosteric_A_PVA_/ S267K/L368D/K370S

SEQ ID NO: 2244 - protein, 479 aa, Artificial Sequence; identical to SEQ ID NO: 1943
  Description of Artificial Sequence: Synthetic polypeptide
  XENP37380 Chain 2 - TBRII-A[TGF-beta-RII]_L1_H1.1_scFv(GKPGS)4_ Fc(216)_IgG1_C220S/PVA_/S267K/S364K/E357Q

SEQ ID NO: 2245 - protein, 213 aa, Artificial Sequence; identical to SEQ ID NO: 2129
  Description of Artificial Sequence: Synthetic polypeptide
  XENP37380 Chain 3 - 5D7[CD5]_L1 Light Chain

SEQ ID NO: 2246 - protein, 449 aa, Artificial Sequence; identical to SEQ ID NO: 2127
  Description of Artificial Sequence: Synthetic polypeptide
  XENP37381 Chain 1 - 5D7[CD5]_H1_IgG1_pI(-)_Isosteric_A_PVA_/ S267K/L368D/K370S

SEQ ID NO: 2247 - protein, 479 aa, Artificial Sequence; identical to SEQ ID NO: 1952
  Description of Artificial Sequence: Synthetic polypeptide
  XENP37381 Chain 2 - TBRII-A[TGF-beta-RII]_H1.34_L1_scFv(GKPGS)4_ Fc(216)_IgG1_C220S/PVA_/S267K/S364K/E357Q

SEQ ID NO: 2248 - protein, 213 aa, Artificial Sequence; identical to SEQ ID NO: 2129
  Description of Artificial Sequence: Synthetic polypeptide
  XENP37381 Chain 3 - 5D7[CD5]_L1 Light Chain

SEQ ID NO: 2249 - protein, 448 aa, Artificial Sequence
  Description of Artificial Sequence: Synthetic polypeptide
  XENP37385 Chain 1 -  Cd5-A[CD5]_H0L0_Fab_IgG1_pI(-)_Isosteric_A_ /PVA_/S267K/L368D/K370S
EVQLKESGAELVRPGGSVKISCKGSGYTFTNFAIHWVKQSHIKTLEWIGLISTSSGDVSYNQKFKDKATMTVDKSSSTAYMELARLTSEDSAIYYCARHYGANNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2250 - protein, 479 aa, Artificial Sequence; identical to SEQ ID NO: 1907
  Description of Artificial Sequence: Synthetic polypeptide
  XENP37385 Chain 2 -  TBRII-A[TGF-beta-RII]_H1.1_L1_scFv(GKPGS)4_ Fc(216)_IgG1_C220S/PVA_/S267K/S364K/E357Q

SEQ ID NO: 2251 - protein, 215 aa, Artificial Sequence
  Description of Artificial Sequence: Synthetic polypeptide
  XENP37385 Chain 3 -  Cd5-A[CD5]_L0
EIVLTQSPTIMSASPGEQVTMTCRTNSSVSSSYLHWYQQKSGASPKLWIYGTSNLASGVPTRFSGSGSGTSYSLTISSVEAGDAATYFCQQYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2252 - protein, 448 aa, Artificial Sequence
  Description of Artificial Sequence: Synthetic polypeptide
  XENP37388 Chain 1 -  Cd5-B[CD5]_H0L0_Fab_IgG1_pI(-)_Isosteric_A_ /PVA_/S267K/L368D/K370S
QVTLKESGAELVRPGASVKLSCKASGYSFTSYWMNWVKQRPGQGLEWIGMIHPSDSETRLNQKFKDKATLTVDKSSSTAYMQLSSPTSEDSAVYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2253 - protein, 479 aa, Artificial Sequence; identical to SEQ ID NO: 1907
  Description of Artificial Sequence: Synthetic polypeptide
  XENP37388 Chain 2 -  TBRII-A[TGF-beta-RII]_H1.1_L1_scFv(GKPGS)4_ Fc(216)_IgG1_C220S/PVA_/S267K/S364K/E357Q

SEQ ID NO: 2254 - protein, 214 aa, Artificial Sequence
  Description of Artificial Sequence: Synthetic polypeptide
  XENP37388 Chain 3 -  Cd5-B[CD5]_L0
DIVLTQSPASLSASVGESVTITCRPSENIYGYFAWYQQRQGKSPQLLVYNAKTLAEGVPSRFSGSGSGTHFSLKINSLQPEDFGTYYCQHHYGTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2255 - protein, 448 aa, Artificial Sequence; identical to SEQ ID NO: 2252
  Description of Artificial Sequence: Synthetic polypeptide
  XENP37401 Chain 1 -  Cd5-B[CD5]_H0L0_Fab_IgG1_pI(-)_Isosteric_A_ /PVA_/S267K/L368D/K370S

SEQ ID NO: 2256 - protein, 479 aa, Artificial Sequence; identical to SEQ ID NO: 1919
  Description of Artificial Sequence: Synthetic polypeptide
  XENP37401 Chain 2 -  TBRII-A[TGF-beta-RII]_H1.30_L1_scFv(GKPGS)4 _Fc(216)_IgG1_C220S/PVA_/S267K/S364K/E357Q

SEQ ID NO: 2257 - protein, 214 aa, Artificial Sequence; identical to SEQ ID NO: 2254
  Description of Artificial Sequence: Synthetic polypeptide
  XENP37401 Chain 3 -  Cd5-B[CD5]_L0

SEQ ID NO: 2258 - protein, 448 aa, Artificial Sequence; identical to SEQ ID NO: 2249
  Description of Artificial Sequence: Synthetic polypeptide
  XENP37573 Chain 1 - Cd5-A[CD5]_H0_IgG1_pI(-)_Isosteric_A_/PVA_/ S267K/L368D/K370S

SEQ ID NO: 2259 - protein, 479 aa, Artificial Sequence; identical to SEQ ID NO: 1919
  Description of Artificial Sequence: Synthetic polypeptide
  XENP37573 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2260 - protein, 215 aa, Artificial Sequence; identical to SEQ ID NO: 2251
  Description of Artificial Sequence: Synthetic polypeptide
  XENP37573 Chain 3 - Cd5-A[CD5]_L0 Light Chain

SEQ ID NO: 2261 - protein, 448 aa, Artificial Sequence; identical to SEQ ID NO: 2249
  Description of Artificial Sequence: Synthetic polypeptide
  XENP37575 Chain 1 - Cd5-A[CD5]_H0_IgG1_pI(-)_Isosteric_A_/PVA_/ S267K/L368D/K370S

SEQ ID NO: 2262 - protein, 479 aa, Artificial Sequence; identical to SEQ ID NO: 1931
  Description of Artificial Sequence: Synthetic polypeptide
  XENP37575 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2263 - protein, 215 aa, Artificial Sequence; identical to SEQ ID NO: 2251
  Description of Artificial Sequence: Synthetic polypeptide
  XENP37575 Chain 3 - Cd5-A[CD5]_L0 Light Chain

SEQ ID NO: 2264 - protein, 448 aa, Artificial Sequence; identical to SEQ ID NO: 2252
  Description of Artificial Sequence: Synthetic polypeptide
  XENP37576 Chain 1 - Cd5-B[CD5]_H0_IgG1_pI(-)_Isosteric_A_/PVA_/ S267K/L368D/K370S

SEQ ID NO: 2265 - protein, 479 aa, Artificial Sequence; identical to SEQ ID NO: 1931
  Description of Artificial Sequence: Synthetic polypeptide
  XENP37576 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2266 - protein, 214 aa, Artificial Sequence; identical to SEQ ID NO: 2254
  Description of Artificial Sequence: Synthetic polypeptide
  XENP37576 Chain 3 - Cd5-B[CD5]_L0 Light Chain

SEQ ID NO: 2267 - protein, 448 aa, Artificial Sequence
  Description of Artificial Sequence: Synthetic polypeptide
  XENP37675 Chain 1 - Cd5-A[CD5]_H1_IgG1_pI(-)_Isosteric_A_/PVA_/ S267K/L368D/K370S
QVQLVQSGAEVKKPGASVKVSCKGSGYTFTNFAIHWVRQAPGQTLEWMGLISTSSGDVSYNQKFQGRVTMTVDKSTSTAYMELSSLRSEDTAVYYCARHYGANNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2268 - protein, 479 aa, Artificial Sequence; identical to SEQ ID NO: 1907
  Description of Artificial Sequence: Synthetic polypeptide
  XENP37675 Chain 2 - TBRII-A[TGF-beta-RII]_H1.1_L1_scFv(GKPGS)4_ Fc(216)_IgG1_C220S/PVA_/S267K/S364K/E357Q

SEQ ID NO: 2269 - protein, 215 aa, Artificial Sequence
  Description of Artificial Sequence: Synthetic polypeptide
  XENP37675 Chain 3 - Cd5-A[CD5]_L1 Light Chain
EIVLTQSPGTLSLSPGERATLSCRTNSSVSSSYLHWYQQKPGQSPRLLIYGTSNLASGVPTRFSGSGSGTDYTLTISRLEPEDFAVYFCQQYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2270 - protein, 448 aa, Artificial Sequence; identical to SEQ ID NO: 2267
  Description of Artificial Sequence: Synthetic polypeptide
  XENP37676 Chain 1 - Cd5-A[CD5]_H1_IgG1_pI(-)_Isosteric_A_/PVA_/ S267K/L368D/K370S

SEQ ID NO: 2271 - protein, 479 aa, Artificial Sequence; identical to SEQ ID NO: 1919
  Description of Artificial Sequence: Synthetic polypeptide
  XENP37676 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2272 - protein, 215 aa, Artificial Sequence; identical to SEQ ID NO: 2269
  Description of Artificial Sequence: Synthetic polypeptide
  XENP37676 Chain 3 - Cd5-A[CD5]_L1 Light Chain

SEQ ID NO: 2273 - protein, 448 aa, Artificial Sequence; identical to SEQ ID NO: 2267
  Description of Artificial Sequence: Synthetic polypeptide
  XENP37677 Chain 1 - Cd5-A[CD5]_H1_IgG1_pI(-)_Isosteric_A_/PVA_/ S267K/L368D/K370S

SEQ ID NO: 2274 - protein, 479 aa, Artificial Sequence; identical to SEQ ID NO: 1931
  Description of Artificial Sequence: Synthetic polypeptide
  XENP37677 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2275 - protein, 215 aa, Artificial Sequence; identical to SEQ ID NO: 2269
  Description of Artificial Sequence: Synthetic polypeptide
  XENP37677 Chain 3 - Cd5-A[CD5]_L1 Light Chain

SEQ ID NO: 2276 - protein, 448 aa, Artificial Sequence
  Description of Artificial Sequence: Synthetic polypeptide
  XENP37678 Chain 1 - Cd5-B[CD5]_H1_IgG1_pI(-)_Isosteric_A_/PVA_/ S267K/L368D/K370S
EVQLVQSGAEVKKPGESLKISCKASGYSFTSYWMNWVRQMPGKGLEWMGMIHPSDSETRYNQSFQGQVTISVDKSISTAYLQWSSLKASDTAMYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2277 - protein, 479 aa, Artificial Sequence; identical to SEQ ID NO: 1907
  Description of Artificial Sequence: Synthetic polypeptide
  XENP37678 Chain 2 - TBRII-A[TGF-beta-RII]_H1.1_L1_scFv(GKPGS)4_ Fc(216)_IgG1_C220S/PVA_/S267K/S364K/E357Q

SEQ ID NO: 2278 - protein, 214 aa, Artificial Sequence
  Description of Artificial Sequence: Synthetic polypeptide
  XENP37678 Chain 3 - Cd5-B[CD5]_L1 Light Chain
DIVLTQSPSSLSASVGDRVTITCRPSENIYGYFAWYQQKPGKSPKLLVYNAKTLAEGVPSRFSGSGSGTDFTLTISSLQPEDFATYYCQHHYGTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2279 - protein, 448 aa, Artificial Sequence; identical to SEQ ID NO: 2276
  Description of Artificial Sequence: Synthetic polypeptide
  XENP37679 Chain 1 - Cd5-B[CD5]_H1_IgG1_pI(-)_Isosteric_A_/PVA_/ S267K/L368D/K370S

SEQ ID NO: 2280 - protein, 479 aa, Artificial Sequence; identical to SEQ ID NO: 1919
  Description of Artificial Sequence: Synthetic polypeptide
  XENP37679 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2281 - protein, 214 aa, Artificial Sequence; identical to SEQ ID NO: 2278
  Description of Artificial Sequence: Synthetic polypeptide
  XENP37679 Chain 3 - Cd5-B[CD5]_L1 Light Chain

SEQ ID NO: 2282 - protein, 448 aa, Artificial Sequence; identical to SEQ ID NO: 2276
  Description of Artificial Sequence: Synthetic polypeptide
  XENP37680 Chain 1 - Cd5-B[CD5]_H1_IgG1_pI(-)_Isosteric_A_/PVA_/ S267K/L368D/K370S

SEQ ID NO: 2283 - protein, 479 aa, Artificial Sequence; identical to SEQ ID NO: 1931
  Description of Artificial Sequence: Synthetic polypeptide
  XENP37680 Chain 2 - TBRII-A[TGF-beta-RII]_H1.51_L1_scFv(GKPGS)4_ Fc(216)_IgG1_C220S/PVA_/S267K/S364K/E357Q

SEQ ID NO: 2284 - protein, 214 aa, Artificial Sequence; identical to SEQ ID NO: 2278
  Description of Artificial Sequence: Synthetic polypeptide
  XENP37680 Chain 3 - Cd5-B[CD5]_L1 Light Chain

SEQ ID NO: 2285 - protein, 448 aa, Artificial Sequence; identical to SEQ ID NO: 2276
  Description of Artificial Sequence: Synthetic polypeptide
  XENP37813 Chain 1 - Cd5-B[CD5]_H1_IgG1_pI(-)_Isosteric_A_/PVA_/ S267K/L368D/K370S

SEQ ID NO: 2286 - protein, 479 aa, Artificial Sequence
  Description of Artificial Sequence: Synthetic polypeptide
  XENP37813 Chain 2 - TBRII-A[TGF-beta-RII]_H1.270_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2287 - protein, 214 aa, Artificial Sequence; identical to SEQ ID NO: 2278
  Description of Artificial Sequence: Synthetic polypeptide
  XENP37813 Chain 3 - Cd5-B[CD5]_L1 Light Chain

SEQ ID NO: 2288 - protein, 448 aa, Artificial Sequence; identical to SEQ ID NO: 2276
  Description of Artificial Sequence: Synthetic polypeptide
  XENP37814 Chain 1 - Cd5-B[CD5]_H1_IgG1_pI(-)_Isosteric_A_/PVA_/ S267K/L368D/K370S

SEQ ID NO: 2289 - protein, 479 aa, Artificial Sequence
  Description of Artificial Sequence: Synthetic polypeptide
  XENP37814 Chain 2 - TBRII-A[TGF-beta-RII]_H1.189_L1.53_scFv (GKPGS)4_Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2290 - protein, 214 aa, Artificial Sequence; identical to SEQ ID NO: 2278
  Description of Artificial Sequence: Synthetic polypeptide
  XENP37814 Chain 3 - Cd5-B[CD5]_L1 Light Chain

SEQ ID NO: 2291 - protein, 448 aa, Artificial Sequence; identical to SEQ ID NO: 2276
  Description of Artificial Sequence: Synthetic polypeptide
  XENP37815 Chain 1 - Cd5-B[CD5]_H1_IgG1_pI(-)_Isosteric_A_/PVA_/ S267K/L368D/K370S

SEQ ID NO: 2292 - protein, 479 aa, Artificial Sequence
  Description of Artificial Sequence: Synthetic polypeptide
  XENP37815 Chain 2 - TBRII-A[TGF-beta-RII]_H1.271_L1.53_scFv (GKPGS)4_Fc(216)_IgG1_C220S/PVA_/S267K/S364K/E357Q
QLQVQESGPGLVKPSETLSLTCTVSGGSISSSYFSWHWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2293 - protein, 214 aa, Artificial Sequence; identical to SEQ ID NO: 2278
  Description of Artificial Sequence: Synthetic polypeptide
  XENP37815 Chain 3 - Cd5-B[CD5]_L1 Light Chain

SEQ ID NO: 2294 - protein, 448 aa, Artificial Sequence; identical to SEQ ID NO: 2276
  Description of Artificial Sequence: Synthetic polypeptide
  XENP37816 Chain 1 - Cd5-B[CD5]_H1_IgG1_pI(-)_Isosteric_A_/PVA_/ S267K/L368D/K370S

SEQ ID NO: 2295 - protein, 479 aa, Artificial Sequence
  Description of Artificial Sequence: Synthetic polypeptide
  XENP37816 Chain 2 - TBRII-A[TGF-beta-RII]_H1.270_L1.53_scFv (GKPGS)4_Fc(216)_IgG1_C220S/PVA_/S267K/S364K/E357Q
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2296 - protein, 214 aa, Artificial Sequence; identical to SEQ ID NO: 2278
  Description of Artificial Sequence: Synthetic polypeptide
  XENP37816 Chain 3 - Cd5-B[CD5]_L1 Light Chain

SEQ ID NO: 2297 - protein, 448 aa, Artificial Sequence; identical to SEQ ID NO: 2276
  Description of Artificial Sequence: Synthetic polypeptide
  XENP37817 Chain 1 - Cd5-B[CD5]_H1_IgG1_pI(-)_Isosteric_A_/PVA_/ S267K/L368D/K370S

SEQ ID NO: 2298 - protein, 479 aa, Artificial Sequence
  Description of Artificial Sequence: Synthetic polypeptide
  XENP37817 Chain 2 - TBRII-A[TGF-beta-RII]_H1.272_L1_scFv(GKPGS)4 _Fc(216)_IgG1_C220S/PVA_/S267K/S364K/E357Q
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2299 - protein, 214 aa, Artificial Sequence; identical to SEQ ID NO: 2278
  Description of Artificial Sequence: Synthetic polypeptide
  XENP37817 Chain 3 - Cd5-B[CD5]_L1 Light Chain

SEQ ID NO: 2300 - protein, 448 aa, Artificial Sequence; identical to SEQ ID NO: 2276
  Description of Artificial Sequence: Synthetic polypeptide
  XENP37818 Chain 1 - Cd5-B[CD5]_H1_IgG1_pI(-)_Isosteric_A_/PVA_/ S267K/L368D/K370S

SEQ ID NO: 2301 - protein, 479 aa, Artificial Sequence
  Description of Artificial Sequence: Synthetic polypeptide
  XENP37818 Chain 2 - TBRII-A[TGF-beta-RII]_H1.190_L1.53_scFv (GKPGS)4_Fc(216)_IgG1_C220S/PVA_/S267K/S364K/E357Q
QLQVQESGPGLVKPSETLSLTCTVSGGSISSSYFSWGWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2302 - protein, 214 aa, Artificial Sequence; identical to SEQ ID NO: 2278
  Description of Artificial Sequence: Synthetic polypeptide
  XENP37818 Chain 3 - Cd5-B[CD5]_L1 Light Chain

SEQ ID NO: 2303 - protein, 448 aa, Artificial Sequence; identical to SEQ ID NO: 2276
  Description of Artificial Sequence: Synthetic polypeptide
  XENP37819 Chain 1 - Cd5-B[CD5]_H1_IgG1_pI(-)_Isosteric_A_/PVA_/ S267K/L368D/K370S

SEQ ID NO: 2304 - protein, 479 aa, Artificial Sequence
  Description of Artificial Sequence: Synthetic polypeptide
  XENP37819 Chain 2 - TBRII-A[TGF-beta-RII]_H1.273_L1.53_scFv (GKPGS)4_Fc(216)_IgG1_C220S/PVA_/S267K/S364K/E357Q
QLQVQESGPGLVKPSETLSLTCTVSGGSISSSYFSWHWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2305 - protein, 214 aa, Artificial Sequence; identical to SEQ ID NO: 2278
  Description of Artificial Sequence: Synthetic polypeptide
  XENP37819 Chain 3 - Cd5-B[CD5]_L1 Light Chain

SEQ ID NO: 2306 - protein, 448 aa, Artificial Sequence; identical to SEQ ID NO: 2276
  Description of Artificial Sequence: Synthetic polypeptide
  XENP37820 Chain 1 - Cd5-B[CD5]_H1_IgG1_pI(-)_Isosteric_A_/PVA_/ S267K/L368D/K370S

SEQ ID NO: 2307 - protein, 479 aa, Artificial Sequence
  Description of Artificial Sequence: Synthetic polypeptide
  XENP37820 Chain 2 - TBRII-A[TGF-beta-RII]_H1.272_L1.53_scFv (GKPGS)4_Fc(216)_IgG1_C220S/PVA_/S267K/S364K/E357Q
QLQVQESGPGLVKPSETLSLTCTVSGGSISSSYFSWGWIRQPPGKGLEWIGSFNYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2308 - protein, 214 aa, Artificial Sequence; identical to SEQ ID NO: 2278
  Description of Artificial Sequence: Synthetic polypeptide
  XENP37820 Chain 3 - Cd5-B[CD5]_L1 Light Chain

SEQ ID NO: 2309 - protein, 448 aa, Artificial Sequence; identical to SEQ ID NO: 2276
  Description of Artificial Sequence: Synthetic polypeptide
  XENP37821 Chain 1 - Cd5-B[CD5]_H1_IgG1_pI(-)_Isosteric_A_/PVA_/ S267K/L368D/K370S

SEQ ID NO: 2310 - protein, 479 aa, Artificial Sequence
  Description of Artificial Sequence: Synthetic polypeptide
  XENP37821 Chain 2 - TBRII-A[TGF-beta-RII]_H1.274_L1_scFv(GKPGS)4 _Fc(216)_IgG1_C220S/PVA_/S267K/S364K/E357Q
QLQVQESGPGLVKPSETLSLTCTVSGGSISNAYFSWGWIRQPPGKGLEWIGSFNYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2311 - protein, 214 aa, Artificial Sequence; identical to SEQ ID NO: 2278
  Description of Artificial Sequence: Synthetic polypeptide
  XENP37821 Chain 3 - Cd5-B[CD5]_L1 Light Chain

SEQ ID NO: 2312 - protein, 448 aa, Artificial Sequence; identical to SEQ ID NO: 2276
  Description of Artificial Sequence: Synthetic polypeptide
  XENP37822 Chain 1 - Cd5-B[CD5]_H1_IgG1_pI(-)_Isosteric_A_/PVA_/ S267K/L368D/K370S

SEQ ID NO: 2313 - protein, 479 aa, Artificial Sequence
  Description of Artificial Sequence: Synthetic polypeptide
  XENP37822 Chain 2 - TBRII-A[TGF-beta-RII]_H1.201_L1.53_scFv (GKPGS)4_Fc(216)_IgG1_C220S/PVA_/S267K/S364K/E357Q
QLQVQESGPGLVKPSETLSLTCTVSGGSISNAYFSWGWIRQPPGKGLEWIGSFYYGGKTYYNPSLKSRATISIDTSKNQFSLKLSSVTAADTAVYYCARGPTLIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNYPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2314 - protein, 214 aa, Artificial Sequence; identical to SEQ ID NO: 2278
  Description of Artificial Sequence: Synthetic polypeptide
  XENP37822 Chain 3 - Cd5-B[CD5]_L1 Light Chain

SEQ ID NO: 2315 - protein, 448 aa, Artificial Sequence; identical to SEQ ID NO: 2276
  Description of Artificial Sequence: Synthetic polypeptide
  XENP38116 Chain 1 - Cd5-B[CD5]_H1_IgG1_pI(-)_Isosteric_A_/PVA_/ S267K/L368D/K370S

SEQ ID NO: 2316 - protein, 479 aa, Artificial Sequence; identical to SEQ ID NO: 1919
  Description of Artificial Sequence: Synthetic polypeptide
  XENP38116 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2317 - protein, 214 aa, Artificial Sequence; identical to SEQ ID NO: 2254
  Description of Artificial Sequence: Synthetic polypeptide
  XENP38116 Chain 3 - Cd5-B[CD5]_L0 Light Chain

SEQ ID NO: 2318 - protein, 448 aa, Artificial Sequence; identical to SEQ ID NO: 2252
  Description of Artificial Sequence: Synthetic polypeptide
  XENP38117 Chain 1 - Cd5-B[CD5]_H0_IgG1_pI(-)_Isosteric_A_/PVA_/ S267K/L368D/K370S

SEQ ID NO: 2319 - protein, 479 aa, Artificial Sequence; identical to SEQ ID NO: 1919
  Description of Artificial Sequence: Synthetic polypeptide
  XENP38117 Chain 2 - TBRII-A[TGF-beta-RII]_H1.30_L1_scFv(GKPGS)4_ Fc(216)_IgG1_C220S/PVA_/S267K/S364K/E357Q

SEQ ID NO: 2320 - protein, 214 aa, Artificial Sequence; identical to SEQ ID NO: 2278
  Description of Artificial Sequence: Synthetic polypeptide
  XENP38117 Chain 3 - Cd5-B[CD5]_L1 Light Chain

SEQ ID NO: 2321 - protein, 448 aa, Artificial Sequence
  Description of Artificial Sequence: Synthetic polypeptide
  XENP39131 Chain 1 - Cd5-B[CD5]_H2_IgG1_pI(-)_Isosteric_A_/PVA_/ S267K/L368D/K370S
QVQLVQSGAEVKKPGASVKVSCKASGYSFTSYWMNWVRQAPGQGLEWMGMIHPSDSETRYNQKFQGRVTMTVDKSTSTAYMELSSLRSEDTAVYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2322 - protein, 479 aa, Artificial Sequence; identical to SEQ ID NO: 2131
  Description of Artificial Sequence: Synthetic polypeptide
  XENP39131 Chain 2 - TBRII-A[TGF-beta-RII]_H1.212_L1_scFv(GKPGS)4 _Fc(216)_IgG1_C220S/PVA_/S267K/S364K/E357Q

SEQ ID NO: 2323 - protein, 214 aa, Artificial Sequence; identical to SEQ ID NO: 2278
  Description of Artificial Sequence: Synthetic polypeptide
  XENP39131 Chain 3 - Cd5-B[CD5]_L1 Light Chain

SEQ ID NO: 2324 - protein, 448 aa, Artificial Sequence
  Description of Artificial Sequence: Synthetic polypeptide
  XENP39132 Chain 1 - Cd5-B[CD5]_H1.23__IgG1_pI(-)_Isosteric_A_/ PVA_/S267K/L368D/K370S
EVQLVQSGAEVKKPGESLKISCKASGYSFTSYWMNWVRQMPGKGLEWMGMIYPSDSETRYNQSFQGQVTISVDKSISTAYLQWSSLKASDTAMYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2325 - protein, 479 aa, Artificial Sequence; identical to SEQ ID NO: 2131
  Description of Artificial Sequence: Synthetic polypeptide
  XENP39132 Chain 2 - TBRII-A[TGF-beta-RII]_H1.212_L1_scFv(GKPGS)4 _Fc(216)_IgG1_C220S/PVA_/S267K/S364K/E357Q

SEQ ID NO: 2326 - protein, 214 aa, Artificial Sequence; identical to SEQ ID NO: 2278
  Description of Artificial Sequence: Synthetic polypeptide
  XENP39132 Chain 3 - Cd5-B[CD5]_L1 Light Chain

SEQ ID NO: 2327 - protein, 448 aa, Artificial Sequence
  Description of Artificial Sequence: Synthetic polypeptide
  XENP39133 Chain 1 - Cd5-B[CD5]_H1.36__IgG1_pI(-)_Isosteric_A_/ PVA_/S267K/L368D/K370S
EVQLVQSGAEVKKPGESLKISCKASGYSFTSYWMNWVRQMPGKGLEWMGMIHPSDSETRYNQKFQGQVTISVDKSISTAYLQWSSLKASDTAMYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 2328 - protein, 479 aa, Artificial Sequence; identical to SEQ ID NO: 2131
  Description of Artificial Sequence: Synthetic polypeptide
  XENP39133 Chain 2 - TBRII-A[TGF-beta-RII]_H1.212_L1_scFv(GKPGS)4 _Fc(216)_IgG1_C220S/PVA_/S267K/S364K/E357Q

SEQ ID NO: 2329 - protein, 214 aa, Artificial Sequence; identical to SEQ ID NO: 2278
  Description of Artificial Sequence: Synthetic polypeptide
  XENP39133 Chain 3 - Cd5-B[CD5]_L1 Light Chain

SEQ ID NO: 2330 - protein, 448 aa, Artificial Sequence; identical to SEQ ID NO: 2321
  Description of Artificial Sequence: Synthetic polypeptide
  XENP40323 Chain 1 - Cd5-B[CD5]_H2_IgG1_pI(-)_Isosteric_A_/PVA_/ S267K/L368D/K370S

SEQ ID NO: 2331 - protein, 479 aa, Artificial Sequence; identical to SEQ ID NO: 2039
  Description of Artificial Sequence: Synthetic polypeptide
  XENP40323 Chain 2 - TBRII-A[TGF-beta-RII]_H1.201_L1_scFv(GKPGS)4 _Fc(216)_IgG1_C220S/PVA_/S267K/S364K/E357Q

SEQ ID NO: 2332 - protein, 214 aa, Artificial Sequence; identical to SEQ ID NO: 2278
  Description of Artificial Sequence: Synthetic polypeptide
  XENP40323 Chain 3 - Cd5-B[CD5]_L1 Light Chain

SEQ ID NO: 2333 - protein, 449 aa, Artificial Sequence; identical to SEQ ID NO: 2127
  Description of Artificial Sequence: Synthetic polypeptide
  XENP38257 Chain 1 - 5D7[CD5]_H1_IgG1_pI(-)_Isosteric_A_/PVA_/ S267K/L368D/K370S

SEQ ID NO: 2334 - protein, 353 aa, Artificial Sequence; identical to SEQ ID NO: 2059
  Description of Artificial Sequence: Synthetic polypeptide
  XENP38257 Chain 2 - TBRII-B[TGF-beta-RII]_H1_Fc(216)_IgG1_C220S/ PVA_/S267K/S364K/E357Q

SEQ ID NO: 2335 - protein, 213 aa, Artificial Sequence; identical to SEQ ID NO: 2129
  Description of Artificial Sequence: Synthetic polypeptide
  XENP38257 Chain 3 - 5D7[CD5]_L1 Light Chain

SEQ ID NO: 2336 - protein, 448 aa, Artificial Sequence; identical to SEQ ID NO: 2321
  Description of Artificial Sequence: Synthetic polypeptide
  XENP38257 Chain 1 - Cd5-B[CD5]_H2_IgG1_pI(-)_Isosteric_A_/PVA_/ S267K/L368D/K370S

SEQ ID NO: 2337 - protein, 214 aa, Artificial Sequence; identical to SEQ ID NO: 2278
  Description of Artificial Sequence: Synthetic polypeptide
  XENP38257 Chain 3 - Cd5-B[CD5]_L1 Light Chain

SEQ ID NO: 2338 - protein, 353 aa, Artificial Sequence; identical to SEQ ID NO: 2053
  Description of Artificial Sequence: Synthetic polypeptide
  XENCXXX Chain 1 - TBRII-B[TGF-beta-RII]_H1_VHH_Fc(216)_IgG1_pI(-)_ Isosteric_A_C220S/PVA_/S267K/L368D/K370S

SEQ ID NO: 2339 - protein, 477 aa, Artificial Sequence
  Description of Artificial Sequence: Synthetic polypeptide
  XENCXXX Chain 2 - 5D7[CD5]H1L1_scFv(GKPGS)4_Fc(216)_IgG1_C220S /PVA_/S267K/S364K/E357Q
EVQLVESGGGVVQPGRSLRLSCTFSGFSLSTSGMGVGWIRQAPGKGLEWVAHIWWDDDVYYNPSLKSRLTITKDASTDTVYMELSSLRSEDTAVYYCVRRRATGTGFDYWGQGTLVTVSSGKPGSGKPGSGKPGSGKPGSNIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2340 - protein, 477 aa, Artificial Sequence
  Description of Artificial Sequence: Synthetic polypeptide
  XENCXXX Chain 2 - Cd5-B[CD5]H2L1_scFv(GKPGS)4_Fc(216)_IgG1_C220S /PVA_/S267K/S364K/E357Q
QVQLVQSGAEVKKPGASVKVSCKASGYSFTSYWMNWVRQAPGQGLEWMGMIHPSDSETRYNQKFQGRVTMTVDKSTSTAYMELSSLRSEDTAVYYCARWGDHDDAMDFWGQGTMVTVSSGKPGSGKPGSGKPGSGKPGSDIVLTQSPSSLSASVGDRVTITCRPSENIYGYFAWYQQKPGKSPKLLVYNAKTLAEGVPSRFSGSGSGTDFTLTISSLQPEDFATYYCQHHYGTPFTFGPGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2341 - protein, 29 aa, Artificial Sequence
  Description of Artificial Sequence: Synthetic peptide
  TBRII-A VH HFR1
  MOD_RES (2)..(2): L or V
  MOD_RES (4)..(4): V or L
  MOD_RES (9)..(9): P or S
  MOD_RES (16)..(16): E or Q
  MOD_RES (23)..(23): T or A
  MOD_RES (27)..(27): G or Y
  MOD_RES (29)..(29): I, F, or V
QXQXQESGXGLVKPSXTLSLTCXVSGXSX

SEQ ID NO: 2342 - protein, 7 aa, Artificial Sequence
  Description of Artificial Sequence: Synthetic peptide
  TBRII-A VH HCDR1
  MOD_RES (1)..(1): N, D, E, G, S, T, Q, R, or H
  MOD_RES (2)..(2): S, A, G, T, or H
  MOD_RES (3)..(3): Y, A, D, G, or H
  MOD_RES (4)..(4): F, H, S, or Y
  MOD_RES (5)..(5): S, A, T, Y, or H
  MOD_RES (6)..(6): W, I, or M
  MOD_RES (7)..(7): G, A, H, N, or S
XXXXXXX

SEQ ID NO: 2343 - protein, 14 aa, Artificial Sequence
  Description of Artificial Sequence: Synthetic peptide
  TBRII-A VH HFR2
  MOD_RES (2)..(2): I or V
  MOD_RES (5)..(5): P, A, or H
WXRQXPGKGLEWIG

SEQ ID NO: 2344 - protein, 16 aa, Artificial Sequence
  Description of Artificial Sequence: Synthetic peptide
  TBRII-A VH HCDR2
  MOD_RES (3)..(3): Y, D, H, K, N, or S
  MOD_RES (4)..(4): Y, H, or S
  MOD_RES (6)..(6): E, G, or S
  MOD_RES (7)..(7): K, D, N, or S
  MOD_RES (8)..(8): T or I
  MOD_RES (9)..(9): Y, F, H, N, or S
  MOD_RES (11)..(11): N, A, or S
  MOD_RES (15)..(15): K, E, or Q
  MOD_RES (16)..(16): S or G
SFXXGXXXXYXPSLXX

SEQ ID NO: 2345 - protein, 32 aa, Artificial Sequence
  Description of Artificial Sequence: Synthetic polypeptide
  TBRII-A VH HFR3
  MOD_RES (2)..(2): A, F, or V
  MOD_RES (6)..(6): I or V
  MOD_RES (8)..(8): T or H
  MOD_RES (11)..(11): S, N, or H
  MOD_RES (16)..(16): K or Q
  MOD_RES (23)..(23): A, E, or V
  MOD_RES (31)..(31): P or A
RXTISXDXSKXQFSLXLSSVTAXDTAVYYCXR

SEQ ID NO: 2346 - protein, 11 aa, Artificial Sequence
  Description of Artificial Sequence: Synthetic peptide
  TBRII-A VH HCDR3
  MOD_RES (3)..(3): T, A, D, N, or S
  MOD_RES (4)..(4): M, V, A, E, S, T, Q, L, I, or H
  MOD_RES (5)..(5): I, A, D, N, or V
  MOD_RES (6)..(6): R, A, H, E, K, Q, or S
  MOD_RES (9)..(9): I, F, or M
  MOD_RES (11)..(11): S, H, L, V, or Y
GPXXXXGVXDX

SEQ ID NO: 2347 - protein, 11 aa, Artificial Sequence
  Description of Artificial Sequence: Synthetic peptide
  TBRII-A VH HFR4
  MOD_RES (6)..(6): L, M, or T
WGQGTXVTVSS

SEQ ID NO: 2348 - protein, 23 aa, Artificial Sequence
  Description of Artificial Sequence: Synthetic peptide
  TBRII-A VL LFR1
  MOD_RES (4)..(4): L or M
  MOD_RES (9)..(9): A, G, or P
  MOD_RES (13)..(13): L or V
  MOD_RES (19)..(19): A or V
EIVXTQSPXTLSXSPGERXTLSC

SEQ ID NO: 2349 - protein, 11 aa, Artificial Sequence
  Description of Artificial Sequence: Synthetic peptide
  TBRII-A VL LCDR1
  MOD_RES (1)..(1): R or G
  MOD_RES (5)..(5): S or G
  MOD_RES (7)..(7): R, K, Q, or S
  MOD_RES (8)..(8): S, N, or T
  MOD_RES (9)..(9): Y, H, or N
  MOD_RES (11)..(11): A, N, S, or T
XASQXVXXXLX

SEQ ID NO: 2350 - protein, 15 aa, Artificial Sequence
  Description of Artificial Sequence: Synthetic peptide
  TBRII-A VL LFR2
  MOD_RES (8)..(8): Q, K, or L
WYQQKPGXAPRLLIY

SEQ ID NO: 2351 - protein, 7 aa, Artificial Sequence
  Description of Artificial Sequence: Synthetic peptide
  TBRII-A VL LCDR2
  MOD_RES (1)..(1): D, E, G, or S
  MOD_RES (4)..(4): N, D, S, T, or H
  MOD_RES (7)..(7): T or S
XASXRAX

SEQ ID NO: 2352 - protein, 32 aa, Artificial Sequence
  Description of Artificial Sequence: Synthetic polypeptide
  TBRII-A VL LFR3
  MOD_RES (1)..(1): G or S
  MOD_RES (2)..(2): I or V
  MOD_RES (4)..(4): A or D
  MOD_RES (14)..(14): D or E
  MOD_RES (21)..(21): S or R
  MOD_RES (23)..(23): E or Q
  MOD_RES (24)..(24): P or S
  MOD_RES (29)..(29): V or T
XXPXRFSGSGSGTXFTLTISXLXXEDFAXYYC

SEQ ID NO: 2353 - protein, 9 aa, Artificial Sequence
  Description of Artificial Sequence: Synthetic peptide
  TBRII-A VL LCDR3
  MOD_RES (4)..(4): S, A, G, N, T, or H
  MOD_RES (5)..(5): N, D, S, Q, or H
  MOD_RES (6)..(6): W, H, V, I, L, S, or Y
  MOD_RES (8)..(8): P, F, I, L, W, or Y
QQRXXXPXT

SEQ ID NO: 2354 - protein, 10 aa, Artificial Sequence
  Description of Artificial Sequence: Synthetic peptide
  TBRII-A VL LFR4
  MOD_RES (3)..(3): Q, G, or P
  MOD_RES (7)..(7): V or L
FGXGTKXEIK

SEQ ID NO: 2355 - protein, 30 aa, Artificial Sequence
  Description of Artificial Sequence: Synthetic polypeptide
  Cd5-B VH HFR1
  MOD_RES (1)..(1): E or Q
  MOD_RES (3)..(3): Q or T
  MOD_RES (5)..(5): V or K
  MOD_RES (6)..(6): Q or E
  MOD_RES (11)..(11): V or L
  MOD_RES (12)..(12): K or V
  MOD_RES (13)..(13): K or R
  MOD_RES (16)..(16): E or A
  MOD_RES (18)..(18): L or V
  MOD_RES (20)..(20): I or V
XVXLXXSGAEXXXPGXSXKXSCKASGYSFT

SEQ ID NO: 2356 - protein, 5 aa, Artificial Sequence
  Description of Artificial Sequence: Synthetic peptide
  Cd5-B VH HCDR1
  MOD_RES (4)..(4): M, I, L, or V
  MOD_RES (5)..(5): N, G, Q, or D
SYWXX

SEQ ID NO: 2357 - protein, 14 aa, Artificial Sequence
  Description of Artificial Sequence: Synthetic peptide
  Cd5-B VH HFR2
  MOD_RES (3)..(3): R or K
  MOD_RES (5)..(5): M, A, or R
  MOD_RES (8)..(8): K or Q
  MOD_RES (13)..(13): M or I
WVXQXPGXGLEWXG

SEQ ID NO: 2358 - protein, 17 aa, Artificial Sequence
  Description of Artificial Sequence: Synthetic peptide
  Cd5-B VH HCDR2
  MOD_RES (1)..(1): M, I, L, or V
  MOD_RES (3)..(3): H, Y, F, or W
  MOD_RES (5)..(5): S, G, T, or A
  MOD_RES (8)..(8): E, D, Q, or N
  MOD_RES (11)..(11): Y or L
  MOD_RES (12)..(12): N, S, or T
  MOD_RES (13)..(13): Q or P
  MOD_RES (14)..(14): S or K
  MOD_RES (16)..(16): Q or K
  MOD_RES (17)..(17): G or D
XIXPXDSXTRXXXXFXX

SEQ ID NO: 2359 - protein, 32 aa, Artificial Sequence
  Description of Artificial Sequence: Synthetic polypeptide
  Cd5-B VH HFR3
  MOD_RES (1)..(1): Q, K, or R
  MOD_RES (2)..(2): V or A
  MOD_RES (4)..(4): I, L, or M
  MOD_RES (5)..(5): S or T
  MOD_RES (10)..(10): I or T
  MOD_RES (15)..(15): L or M
  MOD_RES (16)..(16): Q or E
  MOD_RES (17)..(17): W or L
  MOD_RES (20)..(20): L or P
  MOD_RES (21)..(21): K, T, or R
  MOD_RES (22)..(22): A or S
  MOD_RES (23)..(23): S or E
  MOD_RES (25)..(25): T or S
  MOD_RES (27)..(27): M or V
XXTXXVDKSXSTAYXXXSSXXXXDXAXYYCAR

SEQ ID NO: 2360 - protein, 10 aa, Artificial Sequence
  Description of Artificial Sequence: Synthetic peptide
  Cd5-B VH HCDR3
WGDHDDAMDF

SEQ ID NO: 2361 - protein, 11 aa, Artificial Sequence
  Description of Artificial Sequence: Synthetic peptide
  Cd5-B VH HFR4
WGQGTMVTVSS

SEQ ID NO: 2362 - protein, 23 aa, Artificial Sequence
  Description of Artificial Sequence: Synthetic peptide
  Cd5-B VL LFR1
  MOD_RES (9)..(9): S or D
  MOD_RES (12)..(12): S or A
  MOD_RES (13)..(13): A or V
  MOD_RES (15)..(15): V or L
  MOD_RES (17)..(17): D or E
  MOD_RES (19)..(19): V or A
  MOD_RES (22)..(22): T or N
DIVLTQSPXSLXXSXGXRXTIXC

SEQ ID NO: 2363 - protein, 11 aa, Artificial Sequence
  Description of Artificial Sequence: Synthetic peptide
  Cd5-B VL LCDR1
  MOD_RES (1)..(1): R or K
XPSENIYGYFA

SEQ ID NO: 2364 - protein, 15 aa, Artificial Sequence
  Description of Artificial Sequence: Synthetic peptide
  Cd5-B VL LFR2
  MOD_RES (8)..(8): K or Q
WYQQKPGXSPKLLVY

SEQ ID NO: 2365 - protein, 7 aa, Artificial Sequence
  Description of Artificial Sequence: Synthetic peptide
  Cd5-B VL LCDR2
NAKTLAE

SEQ ID NO: 2366 - protein, 32 aa, Artificial Sequence
  Description of Artificial Sequence: Synthetic polypeptide
  Cd5-B VL LFR3
  MOD_RES (24)..(24): P or A
  MOD_RES (27)..(27): F or V
  MOD_RES (29)..(29): T or V
GVPSRFSGSGSGTDFTLTISSLQXEDXAXYYC

SEQ ID NO: 2367 - protein, 9 aa, Artificial Sequence
  Description of Artificial Sequence: Synthetic peptide
  Cd5-B VL LCDR3
QHHYGTPFT

SEQ ID NO: 2368 - protein, 10 aa, Artificial Sequence
  Description of Artificial Sequence: Synthetic peptide
  Cd5-B VL LFR4
FGPGTKVEIK

SEQ ID NO: 2369 - protein, 121 aa, Artificial Sequence; identical to SEQ ID NO: 1324
  Description of Artificial Sequence: Synthetic polypeptide
  TBRII-A_H1.1 Variable heavy (vh) domain

SEQ ID NO: 2370 - protein, 7 aa, Artificial Sequence
  Description of Artificial Sequence: Synthetic peptide
  TBRII-A_H1.1 vhCDR1
NSYFSWG

SEQ ID NO: 2371 - protein, 16 aa, Artificial Sequence
  Description of Artificial Sequence: Synthetic peptide
  TBRII-A_H1.1 vhCDR2
SFYYGEKTYYNPSLKS

SEQ ID NO: 2372 - protein, 11 aa, Artificial Sequence
  Description of Artificial Sequence: Synthetic peptide
  TBRII-A_H1.1 vhCDR3
GPTVIRGVIDS

SEQ ID NO: 2373 - protein, 121 aa, Artificial Sequence; identical to SEQ ID NO: 1352
  Description of Artificial Sequence: Synthetic polypeptide
  TBRII-A_H1.29 Variable heavy (vh) domain

SEQ ID NO: 2374 - protein, 7 aa, Artificial Sequence
  Description of Artificial Sequence: Synthetic peptide
  TBRII-A_H1.29 vhCDR1
NSYFTWG

SEQ ID NO: 2375 - protein, 16 aa, Artificial Sequence
  Description of Artificial Sequence: Synthetic peptide
  TBRII-A_H1.29 vhCDR2
SFYYGEKTYYNPSLKS

SEQ ID NO: 2376 - protein, 11 aa, Artificial Sequence
  Description of Artificial Sequence: Synthetic peptide
  TBRII-A_H1.29 vhCDR3
GPTMIRGVIDS

SEQ ID NO: 2377 - protein, 121 aa, Artificial Sequence; identical to SEQ ID NO: 1353
  Description of Artificial Sequence: Synthetic polypeptide
  TBRII-A_H1.30 Variable heavy (vh) domain

SEQ ID NO: 2378 - protein, 7 aa, Artificial Sequence
  Description of Artificial Sequence: Synthetic peptide
  TBRII-A_H1.30 vhCDR1
NSYFYWG

SEQ ID NO: 2379 - protein, 16 aa, Artificial Sequence
  Description of Artificial Sequence: Synthetic peptide
  TBRII-A_H1.30 vhCDR2
SFYYGEKTYYNPSLKS

SEQ ID NO: 2380 - protein, 11 aa, Artificial Sequence
  Description of Artificial Sequence: Synthetic peptide
  TBRII-A_H1.30 vhCDR3
GPTMIRGVIDS

SEQ ID NO: 2381 - protein, 121 aa, Artificial Sequence; identical to SEQ ID NO: 1359
  Description of Artificial Sequence: Synthetic polypeptide
  TBRII-A_H1.36 Variable heavy (vh) domain

SEQ ID NO: 2382 - protein, 7 aa, Artificial Sequence
  Description of Artificial Sequence: Synthetic peptide
  TBRII-A_H1.36 vhCDR1
NSYFSWS

SEQ ID NO: 2383 - protein, 16 aa, Artificial Sequence
  Description of Artificial Sequence: Synthetic peptide
  TBRII-A_H1.36 vhCDR2
SFYYGEKTYYNPSLKS

SEQ ID NO: 2384 - protein, 11 aa, Artificial Sequence
  Description of Artificial Sequence: Synthetic peptide
  TBRII-A_H1.36 vhCDR3
GPTMIRGVIDS

SEQ ID NO: 2385 - protein, 121 aa, Artificial Sequence; identical to SEQ ID NO: 1374
  Description of Artificial Sequence: Synthetic polypeptide
  TBRII-A_H1.51 Variable heavy (vh) domain

SEQ ID NO: 2386 - protein, 7 aa, Artificial Sequence
  Description of Artificial Sequence: Synthetic peptide
  TBRII-A_H1.51 vhCDR1
NSYFSWG

SEQ ID NO: 2387 - protein, 16 aa, Artificial Sequence
  Description of Artificial Sequence: Synthetic peptide
  TBRII-A_H1.51 vhCDR2
SFNYGEKTYYNPSLKS

SEQ ID NO: 2388 - protein, 11 aa, Artificial Sequence
  Description of Artificial Sequence: Synthetic peptide
  TBRII-A_H1.51 vhCDR3
GPTMIRGVIDS

SEQ ID NO: 2389 - protein, 121 aa, Artificial Sequence; identical to SEQ ID NO: 1524
  Description of Artificial Sequence: Synthetic polypeptide
  TBRII-A_H1.201 Variable heavy (vh) domain

SEQ ID NO: 2390 - protein, 7 aa, Artificial Sequence
  Description of Artificial Sequence: Synthetic peptide
  TBRII-A_H1.201 vhCDR1
NAYFSWG

SEQ ID NO: 2391 - protein, 16 aa, Artificial Sequence
  Description of Artificial Sequence: Synthetic peptide
  TBRII-A_H1.201 vhCDR2
SFYYGGKTYYNPSLKS

SEQ ID NO: 2392 - protein, 11 aa, Artificial Sequence
  Description of Artificial Sequence: Synthetic peptide
  TBRII-A_H1.201 vhCDR3
GPTLIRGVIDS

SEQ ID NO: 2393 - protein, 121 aa, Artificial Sequence; identical to SEQ ID NO: 1535
  Description of Artificial Sequence: Synthetic polypeptide
  TBRII-A_H1.212 Variable heavy (vh) domain

SEQ ID NO: 2394 - protein, 7 aa, Artificial Sequence
  Description of Artificial Sequence: Synthetic peptide
  TBRII-A_H1.212 vhCDR1
SSYFSWS

SEQ ID NO: 2395 - protein, 16 aa, Artificial Sequence
  Description of Artificial Sequence: Synthetic peptide
  TBRII-A_H1.212 vhCDR2
SFYYGGKTYYNPSLKS

SEQ ID NO: 2396 - protein, 11 aa, Artificial Sequence
  Description of Artificial Sequence: Synthetic peptide
  TBRII-A_H1.212 vhCDR3
GPTTIRGVIDS

SEQ ID NO: 2397 - protein, 107 aa, Artificial Sequence; identical to SEQ ID NO: 1757
  Description of Artificial Sequence: Synthetic polypeptide

SEQ ID NO: 2398 - protein, 11 aa, Artificial Sequence
  Description of Artificial Sequence: Synthetic peptide
KPSENIYGYFA

SEQ ID NO: 2399 - protein, 7 aa, Artificial Sequence
  Description of Artificial Sequence: Synthetic peptide
NAKTLAE

SEQ ID NO: 2400 - protein, 9 aa, Artificial Sequence
  Description of Artificial Sequence: Synthetic peptide
QHHYGTPFT

SEQ ID NO: 2401 - protein, 448 aa, Artificial Sequence
  Description of Artificial Sequence: Synthetic polypeptide
QVQLVQSGAEVKKPGASVKVSCKASGYSFTSYWMNWVRQAPGQGLEWMGMIHPSDSETRYNQKFQGRVTMTVDKSTSTAYMELSSLRSEDTAVYYCARWGDHDDAMDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 2402 - protein, 5 aa, Artificial Sequence
  Description of Artificial Sequence: Synthetic peptide
SYWMN

SEQ ID NO: 2403 - protein, 17 aa, Artificial Sequence
  Description of Artificial Sequence: Synthetic peptide
MIHPSDSETRYNQKFQG

SEQ ID NO: 2404 - protein, 10 aa, Artificial Sequence
  Description of Artificial Sequence: Synthetic peptide
WGDHDDAMDF

SEQ ID NO: 2405 - protein, 479 aa, Artificial Sequence; identical to SEQ ID NO: 2048
  Description of Artificial Sequence: Synthetic polypeptide

SEQ ID NO: 2406 - protein, 7 aa, Artificial Sequence
  Description of Artificial Sequence: Synthetic peptide
NAYFSWG

SEQ ID NO: 2407 - protein, 16 aa, Artificial Sequence
  Description of Artificial Sequence: Synthetic peptide
SFYYGGKTYYNPSLKS

SEQ ID NO: 2408 - protein, 11 aa, Artificial Sequence
  Description of Artificial Sequence: Synthetic peptide
GPTLIRGVIDS

SEQ ID NO: 2409 - protein, 11 aa, Artificial Sequence
  Description of Artificial Sequence: Synthetic peptide
RASQSVRSYLA

SEQ ID NO: 2410 - protein, 7 aa, Artificial Sequence
  Description of Artificial Sequence: Synthetic peptide
DASNRAT

SEQ ID NO: 2411 - protein, 9 aa, Artificial Sequence
  Description of Artificial Sequence: Synthetic peptide
QQRSNWPPT

SEQ ID NO: 2412 - protein, 214 aa, Artificial Sequence; identical to SEQ ID NO: 2278
  Description of Artificial Sequence: Synthetic polypeptide

SEQ ID NO: 2413 - protein, 11 aa, Artificial Sequence
  Description of Artificial Sequence: Synthetic peptide
RPSENIYGYFA

SEQ ID NO: 2414 - protein, 7 aa, Artificial Sequence
  Description of Artificial Sequence: Synthetic peptide
NAKTLAE

SEQ ID NO: 2415 - protein, 9 aa, Artificial Sequence
  Description of Artificial Sequence: Synthetic peptide
QHHYGTPFT

SEQ ID NO: 2416 - protein, 448 aa, Artificial Sequence; identical to SEQ ID NO: 2401
  Description of Artificial Sequence: Synthetic polypeptide

SEQ ID NO: 2417 - protein, 5 aa, Artificial Sequence
  Description of Artificial Sequence: Synthetic peptide
SYWMN

SEQ ID NO: 2418 - protein, 17 aa, Artificial Sequence
  Description of Artificial Sequence: Synthetic peptide
MIHPSDSETRYNQKFQG

SEQ ID NO: 2419 - protein, 10 aa, Artificial Sequence
  Description of Artificial Sequence: Synthetic peptide
WGDHDDAMDF

SEQ ID NO: 2420 - protein, 479 aa, Artificial Sequence
  Description of Artificial Sequence: Synthetic polypeptide
QLQVQESGPGLVKPSETLSLTCTVSGGSISSSYFSWSWIRQPPGKGLEWIGSFYYGGKTYYNPSLKSRATISIDTSKNQFSLKLSSVTAADTAVYYCARGPTTIRGVIDSWGQGTLVTVSSGKPGSGKPGSGKPGSGKPGSEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 2421 - protein, 7 aa, Artificial Sequence
  Description of Artificial Sequence: Synthetic peptide
SSYFSWS

SEQ ID NO: 2422 - protein, 16 aa, Artificial Sequence
  Description of Artificial Sequence: Synthetic peptide
SFYYGGKTYYNPSLKS

SEQ ID NO: 2423 - protein, 11 aa, Artificial Sequence
  Description of Artificial Sequence: Synthetic peptide
GPTTIRGVIDS

SEQ ID NO: 2424 - protein, 11 aa, Artificial Sequence
  Description of Artificial Sequence: Synthetic peptide
RASQSVRSYLA

SEQ ID NO: 2425 - protein, 7 aa, Artificial Sequence
  Description of Artificial Sequence: Synthetic peptide
DASNRAT

SEQ ID NO: 2426 - protein, 9 aa, Artificial Sequence
  Description of Artificial Sequence: Synthetic peptide
QQRSNWPPT

SEQ ID NO: 2427 - protein, 214 aa, Artificial Sequence; identical to SEQ ID NO: 2278
  Description of Artificial Sequence: Synthetic polypeptide

SEQ ID NO: 2428 - protein, 11 aa, Artificial Sequence
  Description of Artificial Sequence: Synthetic peptide
RPSENIYGYFA

SEQ ID NO: 2429 - protein, 7 aa, Artificial Sequence
  Description of Artificial Sequence: Synthetic peptide
NAKTLAE

SEQ ID NO: 2430 - protein, 9 aa, Artificial Sequence
  Description of Artificial Sequence: Synthetic peptide
QHHYGTPFT

What is claimed is:

1. A composition comprising a TGFßRII binding domain comprising a variable heavy domain with an amino acid sequence of SEQ ID NO: 1859, and a variable light domain with an amino acid sequence from the group consisting of: SEQ ID NOs: 1607-1653, SEQ ID NO: 1659, SEQ ID NOs: 1661-1662, and SEQ ID NOs: 1665-1667.

2. A composition comprising a TGFßRII binding domain comprising a variable heavy domain with an amino acid sequence selected from the group consisting of SEQ ID NO: 1863, SEQ ID NOs: 1324-1357, SEQ ID NOs: 1359-1370, SEQ ID NO: 1372, SEQ ID NO: 1374, SEQ ID NOs: 1376-1401, SEQ ID NO: 1404-1414, SEQ ID NO: 1418, SEQ ID NOs: 1421-1430, SEQ ID NO: 1504, SEQ ID NO: 1506-1533, SEQ ID NO: 1535, SEQ ID NO: 1537, SEQ ID NO: 1593, SEQ ID NO: 1595, and SEQ ID NO: 1597, and a variable light domain with an amino acid sequence of SEQ ID NO: 1867.

3. A composition comprising a TGFßRII binding domain comprising a variable heavy domain with an amino acid sequence selected from the group consisting of SEQ ID NOs: 1512-1513, SEQ ID NO: 1524, SEQ ID NO: 1594, and SEQ ID NO: 1596, and a variable light domain with an amino acid sequence of SEQ ID NO: 1659.

* * * * *